United States Patent 12,297,285 (CIRCULAR RNA ENCODING CHIMERIC ANTIGEN RECEPTORS TARGETING BCMA) - sequence listing, part 2

SEQ ID NO: 652 - DNA, 601 bp, Human rhinovirus
  C56, strain USA/2017/CA-RGDS-1003, complete genome.1
acccacaccgtctacggacgtagtactcttgtatttcggtacatttgtacgccagttttccctccctcccccctttcacgtaacttatagaagcttgaacatacaggcgaataggaagccaacaaaccatgttggtaaacgccaagcacttctgtttccccggtattagagtgttaggcttctcacgaggctgaagcttgatatatcgttacccgcacagttactaagcagagcctagtaacactttgatctctatactggctggtcgctccgtcagaaaccccctgatagacctggcagatggggctggaaattccccactggtgacagtgttccagcccgcgtggctgcctgtccccctttcttgggggaaagccaatatatagacaaggtgccaagagccgcgtttgctaattgtgagtcctccggcccctgaatgcggctaatccaaccccacagctatcgcatggattccaccatgtaggtagtcgtaatgggcaactgtgggacggaaccgactactttgggtgtccgtgtttccttttataccttattttatctcatggtgacaacatatattgacaagtatatgttgactacc

SEQ ID NO: 653 - DNA, 602 bp, Rhinovirus C
  strain HRV-C45_p1084_s3920_2000 polyprotein gene,1
ttaaaacagctgtgtggttgcacccaccaccaggcacaatgtgcgttgtacactgggattccggtcactttgtacgcctgtttgaccacccccccccatgcaacttagaaaatatacacatagcccaataggatgcggccaaaccaggttcgtcacgggcaagcacttctgtttccccgggtgtgtgaatagaccctaccagggttgaagctgtagcactcgttatccgcatggctactacgcaaatgttagtaacaccctctattgtacttgggatttcgttccgcagataccccatctgtagattagggcgatgaggctacacactccccactggcgacagtggtgtagcctgcgtggcgccctacctgggtctcctgacccaggattccacttacaagacagggtgtgaaggcacaagtgtgctagtcatgagtcctccggcccctgaatgcggctaatcttaaccccgtagccattgcaggcaaaccagtctgtggatggtcgtaatgggtaactacgggatggaaccgactactttgggtgaccgtgtttctcttttttctttatgtaggcactttatggttacaacataagtaacc

SEQ ID NO: 654 - DNA, 603 bp, Human rhinovirus
  A51, strain 12K5, complete genome.1
ttgtacccacccacactgtctacggacgtagtgctctcatattacggtatgcttgcacgccagtttttaccccccttttcccaatttgtaacattagaagtttgtactattaatttggtcaataggaggtagcaagccatgctatctaagaccaagcacttctgttaccccggtatacggagaatagactccaaaagggttgaagctccaaatatcgttatccgcacaattactacgcaaagcctagtaacatcttgataagctctttggttggtcgctcagctgttacccccagtagacttggcagatgaggctgggtattccccactggcgacagtgacccagcctgcgtggctgcctacacacctggcgacaggtgtgaagccaaaagtggacaaggtgtgaagagccccgtgtgctaattgtgattcctccggcccctgaatgcggctaatccaaccccacagccaatgcatgtaaaccaacatgtatttggtcgtaacgggcaactgtgggacggaaccgactactttgggtgtccgtgtttccttttattttaaatgacttgcttatggtgacaaatattggtgtatatttgtcatc

SEQ ID NO: 655 - DNA, 603 bp, Human rhinovirus A
  strain HRV-A80_p1187_sR2954_2009 polyprotein1
ggcttgacctttgacaactttgtgtttgaggagcagtactctactattccggtagttttgtacaccagttttatctcccttcccctatgtaacttagaagacaagcactcaagaccaataggatgataactaaccaagttgtcaaaggtcaagcacttctgtttccccggtcaaaattgatatgctccaccagggcaaaaacagttttggtcgttatccgcaaagtgcctacgcaaagcttagtaacactttgaagaatgtatggttggtcgttccgctattccccatagtagacctggcagatgaggctagaaaatccccactggcgacagtgttctagcctgcgtggctgcctgcgcacctctttgaggtgcgaagccattcctttgacaaggtgcgaagagccccgtgtgctcactttgagtcctccggcccctgaatgtggctaaccttaaccctgcagctagtgcatgcaatccagcatgtctctagtcgtaatgagcaattgcgggatgggaccaactactttgggtgtccgtgtttctctttttacttttaaattgcttatggtgacaatatatataacacatatatattgacacc

SEQ ID NO: 656 - DNA, 604 bp, Duck picornavirus GL/12
  complete genome.1
ttgaaagggggtgctcagggtagctccctgagctcttccctccaccctctttcaacgtctggcccacgatacgggccacctttcaatcttaactaactatccctttaatctatttggattttctggtttagaataatttggaacacataattggattatcttttaggattgtggataggatttgttcgggatatcactcccttcctgtgctaacacatattctaattccctcctttgtctattatctcttggaggtggtgctgaaatattgcaagccacttgagtgtatagatgaagtaggctcaagatgaatgttgtgttactcaaggcaagtgtagctatcactaagatattggtaacgtgaaacggattaccggtagtagcgtgatcttccgtcttagtgctctagtgactagaggacaacgacatggcatcacatatcttaaccctccagttttggcatccgggacagaatgggctggatatccgctttctttctggggtatgtgatgggtggtattggggtaaccaccttgaccatgacgctcgataagagtgaccgcctgatcattgaaacctctagtataaaattcaggctgaaatc

SEQ ID NO: 657 - DNA, 605 bp, Coxsackievirus
  A19, strain BBD26 polyprotein gene, complete cds.1
aactttagaagcaattcaaagagttcaatacagggggtacaaaccagtaccaccacgaacaagcacttctgtttccccggtgaggctgtatagactgtgcccacggtctaaaacggcagatccgttacccgctcaagtacttcgagaagcctagtatcaccttggaatcttcgatgcgttgcgctcagcaccctacccccgggtgtagcttaggtcgatgagtctgggcatgccccaccggcgacggtggcccaggctgcgttggcggcctacccatggctaacgccatgggacgctagttgtgaacaaggtgtgaagagcctattgagctacttgagagtcctccggcccctgaatgcggctaatcccaaccacggagcaagtgcctgcatgccagcaggtagcttgtcgtaacgcgcaagtctgtggcggaaccgactactttgggtgtccgtgtttccttttattcttataatggctgcttatggtgacaatctaagattgttatcatatagcttttggattggccatccggtgattatttgacttttgagcacttgtttaccttatctcatcacatattcatttaattgcttgattgcata

SEQ ID NO: 658 - DNA, 606 bp, Human rhinovirus
  A31, strain SC1031, complete genome.1
taataatagtgtactactccacgtgggaagtacgggtggagtagtacactattattacggtaatcttgtacgccagttttataaccccttcccctatgtaacttagaagtttgaactcaagaccaacaggtggtaatcaaccagattactaaaggtcaagcacttctgtttccccggtcaatattgatatgctccaccagggcaaaaacaattgcgatcgttatccgcaaagtgcctacgcaaagcttagtaacattttgaataatatatggttggtcgttccgctattccccatagtagacctggcagatgaggctggaaactccccactggcgacagtgttccagcctgcgtggctgcctgcgcactctcacgagtgcgaagccatatatttgacaaggtgtgaagagccccgtgtgctcactttgagtcctccggcccctgaatgtggctaaccttaaccctgcagctagtgcatacaagccagtatgtagctagtcgtaatgagcaattgcgggatgggaccaactactttgggtgtccgtgtttcacttttatctttattatttgcttatggtgacagtatatagtgtatatattgttacc

SEQ ID NO: 659 - DNA, 607 bp, Human rhinovirus
  C54, isolate D3490 polyprotein gene, complete cds.1
ttaaaacagctgtgtggttgttcccaccaccaggcacactgtgcgttgtacactgggattccggtcactttgtacgcctgtttgctatcccccccaacttatgtaatttagaagatgtacacaacgcccattaggatgcggccaaaccaggtccgcttagggcaagcacttctgtttccccgggtgtgtgaatagactctaacagggttgaagctgtagcactcgttatccgcgcaactactacgcgaatgttagtagcatcctgtgttgcatttgggatttcgctccgcagaaaaccccatctgtagattagggcaatgaggctacacataccccactggcgacagtggtgtagcctgcgtggtgccctacccaggccttcttggcctgggattccacttacaagacagggtgtgaaggcactagtgtgctagttgtgagtcctccggcccctgaatgcggctaatcttaaccccgtagcccccgcaagtaaaccaacttgtaggtggtcgtaatgagtaattacgggatggaaccgactactttgggtgtccgtgtttccttttattctttatatttgcatcctatggttacaacataagtaatc

SEQ ID NO: 660 - DNA, 608 bp, Human rhinovirus C
  isolate LZY79, complete genome.1
ttaaaactgggtataggttgttcccacctgtaccacccacgtggtgtagtgctcctgtattccggtacacttgcacgccagtttgccctcccttcctgtaacgtagaagtaatataaacagaccaataggggatggcgaaccacgccgttcaaggtcaagcacttctgtttccccggcatgcgaggaatagaccttttcaagggttgaagccacaagtgtcgttacccgcattggtactacacagagcttagtaccgctctggaaacttattggttggtcgttcagccattttcccctggtagacccggcagatgaggcaagaagctccccactggtaacagtgttcttgcctgcgtggctgcctgcacaccctaatgggtgtgaagccaataagtagacagggtgtgaagagccgcgtgtgctaccaatgagtcctccggcccctgaatgcggctaatccaaccccacagctatggcatgcaatccagcatgtgcgtagtcgtaatgagtaattgtgggacggaaccgactactttgggtgtccgtgtttcccttattctcttatgtcttgcctatggtgacaatattaagtattaatattgctacc

SEQ ID NO: 661 - DNA, 608 bp, Human rhinovirus
  C47, isolate CA-RGDS-1001, complete genome.1
ggcatgggttgtacccacccatgccacccaagtggtgtagtgctcctgtatcccggtacacttgcacgccagtttgccctcccttttccccaagtaacttagaagcttacacacaggccactaggaggtggtaatccataccactgatggtcaagcacttctgtctccccggcacgcatggaatagaccttgaaaagggttgaagccataaatgtcgttatccgcattggtactacacaaagcctagtaatgccttgaaacttctacggttggtcgttccgctagatgcacccctctagtagacctggcagatgaggcagggcaaaccccactggcgacagtggccctgcctgcgtggctgcctgcgcgcccacttgggtgcgaagccgatgaacagacaaggtgtgaagagccccgtgtgctaccaatgagtcctccggcccctgaatgcggctaatccaaccccacagctattgcacacaaaccagtgtgtatgtagtcgtaatgagtaattgtgggacggaaccgactactttgggtgtccgtgtttccttttattctttaaatttgcacatggtgacaatattggtagtatcagtattgtcatc

SEQ ID NO: 662 - DNA, 608 bp, Human rhinovirus C
  strain NY-074 polyprotein gene, complete cds.1
ttaaaactgggttatagttgctcccactataaccacccacgcggtgttgtggacttgtatttcggtacacttccatgccagttttatcttcccccctgcaacacttagaagaaatgtacttatggaccaataggcggcggccacccaggtcgttgacggtcaagcacttctgtctccccggtgatactggatacgctttacccaaggcgaaaaccgggctcatcgttatccgcaaagtgcctacgagaagtctagtagcactctgaaaacctatgactggtcgctccactgcaatcccagcagtagacctggcagatggggctagacataccccaccagcgatggtggtctagcccgcgtggctgcctgcacaccctatgggtgtgaagccagaaagtggacagggtgtgaagaacctattgtgctcactttgagtcctccggcccctgaatgtggctaatcctaaccctgcaaccgttgcgcacaacccagtgcgtatgcggtcgtaatgagcaattgcgggatggaaccaactactttgggtgtccgtgtttcttgttattcttttatttgcttatggtgacactgtatagctatacattgtcatc

SEQ ID NO: 663 - DNA, 609 bp, Rhinovirus C
  strain 20692_90_HRV-C polyprotein gene, complete cds.1
taaaactgggtacaggttgttcccacctgtaccacccacgtggtgtggtgctcttgtattccggtacatttgcacgccagtttgctacccctcaccctttgtaacctagaagctattaactcgaccaataggcggtggtaaaccataccacttacggtcaagcacttctgtttccccggtatgcgaggaatagactctcacagggttgaagcctcaagtatcgttatccgcattggtactacgcaaagcctagtagcgcctcggaaatcccttggttggtcgttccgctagtttcccctagtagacctggcagatgaggcaggacattccccactggtgacagtggtcctgcctgcgtggctgcctgcgcacccttcggggtgcgaagccaagtgatggacaaggtgtgaagagccccgtgtgctactaatgagtcctccggcccctgaatgcggctaatccaaccccacagctattgcacacaaaccagtgtgtatatagtcgtaatgagcaattgtgggacggaaccgactactttgggtgtccgtgtttccttttattctcattatcttgcttatggtgacaatactgtgatatagtgttgttacc

SEQ ID NO: 664 - DNA, 609 bp, Human rhinovirus C
  strain HRV-C49_p1277_s6237_2000 polyprotein1
aactgggcttgggttgtgcccacccaagctgcccacgtggcgttgtgctcttgtattccggtacacttgcacgccagtttgcctcccctaccctgcaacgaatttagaagaatggacacaaatagaccaataggtggtgacaatccatgtcactaatggtcaagcacttctgtttccccggtgtgatgtggaataaactcccccagggttgaagccataagcatcgttacccgctacgtgcctacgcaaaacctagtagcattctggagtctacttggttggccgttcagccactaacccgtggtaggcctggcagatgaggctgggcgtaccccactggtaacagtggcccagcctgcgtggctgcctgcccctctttgaggggaagccaattaggtgacagggtgtgaagagtcccgtgtgctcacgtagagtcctccggcccctgaatgtggctaatcctaaccccgcagctattgcacacaatccagtgtgttagtagtcgtaatgggcaactgtgggatggaaccaactactttgggtgtccgtgtttcttgtttttcttttatacttgcttatggtgacaaatagtgcatactgtttgacacc

SEQ ID NO: 665 - DNA, 610 bp, Mouse kobuvirus M-5/USA/2010
  complete genome.1
gtaacttcaagtgtgtgtgctcgtaatcttgactcctgccggaatgccgcccggttcagtgaacaaacagctaggcaagtccctcccttcccctgtggtcggttctcaccggccaccatccctcccccagcctgacgtgttacaggctgtgcaaagcccccgcgaaagctgctcacgtggcaattgtgggtcccccctttgtcaagacaccgagtctttctcccttaaggctagcccggtcccacgaacgtggaactggcaactagtggtgtcactacacgcctccgacctcggacgcggagtgctgttccccaagctgtaaccctgacccaagactgtgctgcctggcaagcaccgtctgggaagatgttccgctgtggctgccaaacctggtaacaggtgccccagtgtgtgtagtcttcctccagtctccggactggcagtcttgtgtaaagatgcagtgtaaggttcaagtgccaaatccctggaaggagtgaccctctactgccctaggaatgctgtgcaggtacccccaacttcggttggggatctgagcacaggctaattgtctacgggtagtttcatttcccatcctctcttttttggcatc

SEQ ID NO: 666 - DNA, 610 bp, Human rhinovirus C
  strain HRV-C02_p1264_s3775_1999 polyprotein1
ttaaaactgggtacaggttgttcccacctgtatcacccacgtggtgtggtgctcttgtattccggtacacttgcacgccagtttgccacccctcacccgtcgtaacttagaagctaacaactcgaccaacaggcggtggtaaaccataccacttacggtcaagcactcctgtttccccggtatgcgaggaatagactcctacagggttgaagcctcaagtatcgttatccgcattggtactacgcaaagcttagtagtgccttgaaagtcccttggttggtcgctccgctagtttcccctagtagacctggcagatgaggcaggacactccccactggcgacagtggtcctgcctgcgtggctgcctgcgcacccttaggggtgcgaagccaagtgacagacaaggtgtgaagagccccgtgtgctaccaatgagtcctccggcccctgaatgcggctaatccaaccccacagctattgcacacaagccagtgtgtatgtagtcgtaatgagcaattgtgggacggaaccgactactttgggtgtccgtgtttccttttattcttatcattctgcttatggtgacaatactgtgaaatagtgttgttacc

SEQ ID NO: 667 - DNA, 610 bp, Human rhinovirus
  54, isolate F05, complete genome.1
ttaaaactggatctaggttgttcccacctagatctcctacatggagttgtactctattattccggtaattttgtacgccagttttatatccctacccccatgtaacttagaagttaagcacaacgaccaataggaggcaattgaccaaattgctaaaggtcaagcacttctgtttccccggtcaagattgatacgctccaccagggcgaaaacaattgagatcgttatccgcaaagtgcctacgcgaagcctagtaacactttgaagagtttatggttggtcgctccgctattccccatagcagacctggcagatgaggctagaagctccccactggtgacagtgttctagcctgcgtggctgcctgcacacccttatgggtgtgaagccatatacttgacagggtgtgaagagcctagtgtgctcactttgagtcctccggcccctgaatgtggctaaccttaaacccgtagctagtgcacacaatccagtgtgtggctagtcgtaatgagcaattacgggatgggaccaactactttgggtgtccgtgtttcactttttccttttgtatttgcttatggtgacaatatatagattatatattgacacc

SEQ ID NO: 668 - DNA, 610 bp, Human rhinovirus
  98, strain ATCC VR-1298, complete genome.1
ttaaaactgggtctaggttgttcccacctaggcctcctacatggagttgtactctattattccggtaattttgtacgccagttttatatcccttcccccatgtaacttagaagtttgacacactgaccaataggtggcaattaaccaaattgctaaaggtcaagcacttctgtttccccggtcaagattgatacgctctaccagggcgaaaacaattgagatcgttatccgcaaagtgcctacgcgaagcctagtaatatcttgaagaatttatggttggtcgctccgccattacccatggtagacctggcagatgaggctagaaattccccactggtgacagtgttctagcctgcgtggctgcctgcacaccctcacgggtgtgaagccatacgtttgacaaggtgtgaagagcctagtgtgctcactttgagtcctccggcccctgaatgtggctaaccttaaacccgtagctggtgcacacaaaccagtgtgtagctagtcgtaatgagcaattacgggatgggaccaactactttgggtgtccgtgtttcactttttccttttatatttgcttatggtgacaatatatagattatatattggcacc

SEQ ID NO: 669 - DNA, 610 bp, Human rhinovirus
  74, complete genome.1
ttaaaactgggtttgggttgatcccacccaaacctcccaagcggagtggtactctgttatttcggtaactttgtacgccagttttatattccctcccccctttaaactgtaaagctaagcacacagaccaatagctgacaatcatccagattgttaatggtcaagcacttctgtttccccggtcaacgttgatatgctccaacagggcaaaaacaactgcgatcgttatccgcaaagtgcctacgcaaagcctagtagcacctttgaagtcatttggttggtcgctccgctgttccccacagtagacctggcagatgaggctagaaataccccactggtgacagtgttctagcctgcgtggctgcctgcacaccctttgggtgtgaagccaaatcatggacaaggtgtgaagagccccgtgtgctcactttgagtcctccggcccctgaatgtggctaaccttaaccctgcagctagagtgcacaatccagtgcatttctagtcgtaatgagcaattgcgggatgggaccaactactttgggtgtccgtgtttcactttttacctattatttgcttatggtgacaatatatataattatatattggcacc

SEQ ID NO: 670 - DNA, 610 bp, Human rhinovirus
  50, strain ATCC VR-517, complete genome.1
ttaaaactgggtccaggttgttcccacctggatctcctaatgggagttgtactctgttattccggtaactttgtatgccagttttatctccctacccccaatgtaacttagaagatgtacacaacgaccaataggtgatgatcaaccagattatcaaaggtcaagcacttctgttttcccggttagagttgatatgctccaacagggcaaaaacaactttaatcgttatccgcaaagcgcctacgcaaagcctagtaacagcttcgaagatttatggttggtcgttccgctgttccccacagtagacctggcagatgaggctagagattccccactggtaacagtgttctagcctgcgtggctgcctgcgcacccttcgggtgcgaagccatatttcggacaaggtgcgaagagccccgtgtgctcgctttgagtcctccggcccctgaatgtggctaaccttaaccctgcagctagtgcatacaaaccagtatgtggctagtcgtaatgagcaattgcgggatgggaccaactactttgggtgtccgtgtttctctttttccttttattattgcttatggtgacaatatatagtttatatattggcacc

SEQ ID NO: 671 - DNA, 610 bp, Human rhinovirus
  C43, strain SC174, complete genome.1
ttaaaactgaaccatagttgttcccactgtggttgcccaaggggcgtggtggtcttgtattacggtacatttccatgccagttttatcaccccttcccgaaacatagaagaaatgcacacaccgaccaataggaggtggtcaaccagaccactaaaggtcaagcacttctgtttccccggttggcttggatatgcttcacccgaggcaaaaaccgagccaatcgttatccgcaaagtgcctacgagaagcctagtagcacccttgaagccaatggttggtcgctccgttgcaaccccagcagcagacctggcagatgaggctgagcattccccaccagcgatggtggctcagcctgcgtggctgcctgcgcatccttcgggatgcgaagccagaaagtggacaaggtgtgaagagcctattgtgctcactttgagtcctccggcccctgaatgtggctaatcctaaccccgcagctactacacataagccaatgtgcaggtagtcgtaacgggcaactgtgggatggaaccaactactttgggtgtccgtgtttccttgttatctttttgaatgcctatggtgacaattgtacagtatacatttgttacc

SEQ ID NO: 672 - DNA, 611 bp, Human rhinovirus
  100, strain ATCC VR-1300, complete genome.1
ttaaaactgaatccagattgttcccatctggatttcctacatggagttgtactctattattccggtaattttgtacgccagttttatcaccccttcccccgtaacttagaagtttgaaacaaaagaccaataggaggtaactatccaagttactataggtcaagcacttctgtttccccggtcaaagttgatatgctccaccagggcaaaaacaattgagatcgttatccgcaaagtgcctacgcaaagcctagtagtatcttgaaaagcatgtggttggttgctccgctgtaccccacagtaaacctggcagatgaggctagaagttccccactggtgacagtgttctagcctgcgtggctgcctgcgcactctttgagtgcgaagccatatgtttgacaaggtgtgaagagccccgtgtgctcactttgagtcctccggcccctgaatgtggctaaccttaaccctgcagctagtgcatgcaatccagcatgtggctagtcgtaatgagcaattgcgggatgggaccaactactttgggtgtccgtgtttcacttttttccttttataattgcttatggtgacaatatatagtgatatatattgacacc

SEQ ID NO: 673 - DNA, 611 bp, Human rhinovirus
  67, strain ATCC VR-1177, complete genome.1
ttaaaactggatctaggttgttcccacctagatctcccaagtggagtggtacactattatcacggtaattttgtacgccggttttatctccccttaccccaagtaacttagaagtattacataaagaccaacaggcagtgattatccagatcactaaaggtcaagcacttctgtctccccggtcaaagttgatatgctccaacagggcaaaaacaactgagatcgttatccgcaaagtgcctacgcagagcctagtaactaccttgaaattacttggttggtcgttccaccaaaccccatggtagacctggcagatgaggctagaaattccccactggtaacagtgttctagcctgcgtggctgcctgcacaccctttgggtgtgaagccaagtaatggacagggtgtgaagagccgagtgtgctcactttgagtcctccggcccctgaatgtggctaaccttaaccctgcagctagagcgcgcaaaccagcgtgtatctagtcgtaatgagcaattgcgggacgggaccaactactttgggtgtccgtgtttctttttattcttatatttgcttatggtgacaatatataattatttgtatattggcacc

SEQ ID NO: 674 - DNA, 611 bp, Human rhinovirus
  A22, strain SC1029, complete genome.1
ataaaactggcgtgcatagttcccatccagatcacccaagtggtgtagtgctctgttattccggtaactttgcacgccagttttattacccctttccccagtaacttagaagctttaatacactgaccaatagggtgcgacaaccagtcgtacaaggtcaagcacttctgtttccccggtcaatgttgatatgctcctccagggcaaaaacaatagcgatcgttatccgcaagatgcctacgcaaagcctagtagcatctttgaaaatacttggttggtcgctcatgtgcaaccccagcattagacctggcagatgaggctagaaattccccactggcgacagtgttctagcctgcgtggctgcctgcacaccctaacgggtgtgaagcctggtattggacaaggtgtgaagagccccgtgtgctcatcttgagtcctccggcccctgaatgcggctaaccttaaacctgcagccattgcttacaatccagtgagtttatggtcgtaatgagcaattgcgggatgggaccgactactttgggtgtccgtgtttctctttttacttaaatttgagcttatggtgacaatatatagcaatatatattggcatc

SEQ ID NO: 675 - DNA, 611 bp, Human rhinovirus C
  isolate LZ651, complete genome.1
ttaaaactgaatcatggttgttcccaccatgattacccacgcggtgcagtggtcttgtattacggtacatttccataccagttttatacaccccaccccgaaacatatagaagtttgtacacaatgaccaataggtggtggccatccaggttactgacggtcgagcacttctgtttccccggtacccttgtatacgcttcacccgaggcgaaaaacgaggttatcgttatccgcaaagtgcctacgagaagcctagtaacacttttgaaacctatggctggtcgctcagctgctcacccagcagtagacctggcagatgaggctagacattccccaccagcgatggtggtctagcctgcgtggctgcctgcacaccctattgggtgtgaagccagaaagtggacagggtgtgaagagcctattgtgctcactttgagtcctccggcccctgaatgtggctaatcctaaccccgtagctgttgcatgcaacccagcatgtatgcagtcgtaatgggcaactatgggatggaaccaactactttgggtgtccgtgtttctcgtttcacttttcattgcttatggtgacaattgtagttgatacacttgttacc

SEQ ID NO: 676 - DNA, 611 bp, Human rhinovirus
  31, strain ATCC VR-506, complete genome.1
ttaaaactgggtgcgagttgttcccactcgcacttcctacgtggagtagtacactattattacggtaattttgtacgccagttttataacccttccccttttgtaacttagaagtttgaacttgagaccaataggtggtgatcaaccagatcgccaaaggtcaagcacttctgtttccccggtcaacattgatatgctccaccagggcaaaaacaattgcgatcgttacccgcaaagtgcctacgcaaagcttagtaatatcttgaacgatatatggttggtcgctccactaatccccatagtagacctggcagatgaggctggaaactccccactggcgacagtgttccagcctgcgtggctgcctgcgcactctcacgagtgcgaagccatatatttgacaaggtgtgaagagccccgtgtgctcactttgagtcctccggcccctgaatgtggctaaccttaaccctgcagctagtgcatacaaaccagtatgtggctagtcgtaatgagcaattgcgggacgggaccaactactttgggtgtccgtgtttcactttttcttttatggtttgcttatggtgacagtatatagtgtatatattgttacc

SEQ ID NO: 677 - DNA, 611 bp, Human rhinovirus
  34, complete genome.1
ttaaaactgggtccaggttgttcccacctggacttcccacgtggagttgtgcactgttattccggtaactttacacgccagttttatctcccttcccaaatgtaacttagaagatgtacacagcgaccaataggtggcaactagccaagttgcttaaggtcaagcacttctgtccccccggtcaatgttgatacgctctcccagggcgaaaacaactgagatcgttatccgcaaggcgcctacacaaaacctagtaacatcttgaatggtatgtggctggtcgttccgctaaaccccatagtagacctggcagatgaggctagaaattccccactggcgacagtgttctagcctgcgtggctgcctgcgtgtccttacggacacgaagccatatacttgacaaggtgtgaagagtcccgtgtgctcgtcttgagtcctccggcccctgaatgtggctaaccttaaccctgcagccagtgcgcacaaaccagtgtgtagctggtcgtaatgagtaattgcgggatgggaccaactactttgggtgtccgtgtttcactttttaccttttattatgcttatggtgacaatatatagatgcatatattgacacc

SEQ ID NO: 678 - DNA, 611 bp, Human rhinovirus
  18, strain ATCC VR-1128, complete genome.1
ttaaaactgaatccaggttgttcccacctggatttcccatgtggagtagtacactgttattccggtaactttgtacgccagttttataaccccttccccttatgtaacttagaagataagcacaaagaccaataggtggtggctatcccagtcactaaaggtcaagcacttctgtttccccggtcaacgttgatatgctccaccagggcaaaaacaaccgagatcgttatccgcaaagtgcctacgcaaagcctagtagcactttgaatagcatgtggttggtcgctccactattccccatagtagacctggcagatgaggctagaaatcccccactggcgacagtgttctagcctgcgtggctgcctgcgtgtcctaacggacacgaagccatatgtttgacaaggtgtgaagagccccgtgtgctcactttgagtcctccggcccccgaatgtggctaaccttaaccctgcagctggggcatacaatccagtgtgaactcagtcgtaatgagcaattgcgggatgggaccaactactttgggtgtccgtgtttcacttttttttataatgcttatggtgacaatatataataatttgtatattggcacc

SEQ ID NO: 679 - DNA, 611 bp, Echovirus
  E1, strain E1_NR-CPE capsid protein gene, partial cds.1
attagctggcccggtacaccaatcgggtcttgaccaagcacttctgttaccccggactgagtatcaataggctgctcacgcggctgaaggagaaaacgttcgttatccggccaattacttcgagaaacctagtaacaccgtgaaggttgcgcagcgtttcgttccgcactaccccagtgtagatcaggtcgatgagtcaccgcatcccccacgggtgaccgtggcggtggctgcgttggcggcctgcccatggggaaacccatgggacgcttcaatattgacacggtgcgaagagtctattgagctaattggtagtcctccggcccctgaatgcggctaatcctaactgcggagcagatacccgcacaccagcgggcagtctgtcgtaatgggtaactctgcagcggaaccgactactttgggtgtccgtgtttccttttatttttatattggctgcttatggtgacaattgaaagattgttaccatatagctattggattggccatccagtgagcaacagagcgattgtatttctctttgttggattcataccactaaactacaatagttataacactctattgtatatcattcatctgaacacaaaaag

SEQ ID NO: 680 - DNA, 612 bp, Canine kobuvirus
  strain UK003, complete genome.1
tttcccctgttcgtaactaagtgtgtgcccaatctcctcactcctgctggcttcaccgaccggcagtgtccaaaatgctaggtgaatcccctccctttcctctgggcttctgcccagcttcctccccccagcctgacgtgacacaggctgtgcaaagaccccgcgaaagctgccaaaagtggcaattgtgggtcccccctttgtaaaggcgtcgagtctttctccctcaaggctagacccgtcagtgaattctgtcgggcaactagtgacgccactgcacgcctctgacctcggccgcggagtgctgccccccaagtcgtgcccctgaccacaagttgtgctgtctggcaaacattgtctgtgagaatgttccgctgtggctgccaagcctggcaacaggctgccccagtgtgcgtagttctcatccagacttcggtctggcaacttgctgttaagacacggcgtaaggggcgtgtgccaacgccctggaacgagtgtccactctaataccccgaggaatgctacgcaggtacccctggttcgccagggatctgagcgtaggctaattgtctaagggtattttcatttcccattctttctttcttgttcata

SEQ ID NO: 681 - DNA, 612 bp, Human rhinovirus
  46, complete genome.1
ttaaaactggatctgggttgttcccacccagatttcccatgtggagtagtactctattattccggtaattttgtacgccagttttatattccctaccccgagtaacttagaagataagcacacaaggccaatagtgggtgattagccaaatcatcaaaggtcaagcacttctgtttcccccggtcaaggttgatatgctctaccagggcaaaaacaactgagatcgttatccgcaaaatgcctacacaaagcctagtatcatcttggaaggcacagagttggtcgctccactattccccatagtagacctggcagatgaggctagaaaatccccactggcgacagtgttctagcctgcgtggctgcctgcgtgccttgcgaggcacgaagccctgtgtttgacaaggtgtgaagagccccgtgtgctcattttgattcctccggcccctgaatgtggctaaccttaaccctgcagctagtgcacacaaaccagtgtgtatctagtcgtaatgagtaattgcgggacgggaccaactactttgggtgtccgtgtttcactttttaccttttaattgcttatggtgacaatatatataaatatatattgacacc

SEQ ID NO: 682 - DNA, 612 bp, Human rhinovirus
  53, complete genome.1
ttaaaactggatctgggttgctcccacccagattacccaagtggtgtagtactctgttattacggtagctttgtacgccagttttatcacccctccccacaatgtaacttagaagttttacacttacagaccaataggatgtgattatccaaatcactaaaggtcaagcacttctgtttccccggttagatttgatacgctccaacagggcgaaaacagatctgatcgttatccgcaagatgcctacgcaaagcttagtagcgctctgaatgctttttggctggttgttccactacaaacccagtagtaaacctggcagatgaggctagaagttccccactggcgacagtgttctagcctgcgtggctgcctgcacaccctatgggtgtgaagccaatcagttgacagggtgtgaagagccccgtgtgctcatcttgagtcctccggcccctgaatgtggctaaccttaaacccgcagccaaggtgtgcaaaccagcacattcttggtcgtaacgagtaattgtgggatgggaccaactactttgggtgtccgtgtttctttttattcttttacaatgcctatggtgacaatatatagtatatattgtcatt

SEQ ID NO: 683 - DNA, 612 bp, Human rhinovirus
  A40, strain 7D5, complete genome.1
ttaaaactgggtccaggttgttcccacctggatctcctacatggagttgtactctgttattccggtaaccttgtacgccagttttatatcccctccccaaatgtaacttagaagttatacacacagaccaataggcggtgatcctccagatcactaacggtcaagcacttctgtctccccggtttgaattgatacgctccaacagggcgaaaacaatttgaatcgttacccgcaaagtgcctacgcaaagcctagtagcactttagaaaatttatggttggtcgctcagctataccccctagtagacctggcagatgaggctagaagtaccccactggcgacagtgttctagcctgcgtggctgcctgcacaccctcacgggtgtgaagccatatatttgacaaggtgtgaagagccccgtgtgctcactttgagtcctccggcccctgaatgtggctaaccttaaccctgcagctagtgcatgtaatccaacatgttgctagtcgtaatgagcaattgcgggatgggaccaactactttgggtgtccgtgtttcactttttaccttttatttgcttatggtgacaatatatataatatatatattggcatc

SEQ ID NO: 684 - DNA, 612 bp, Human rhinovirus A
  isolate N13, complete genome.1
ttgaaactgagtgtgggttgttcccacccacacttcccatgtggagtagtacactgttattacggtaaccttgtacgccagttttatcatccctttccctttgtaacttagaagttttaaacttgagaccaataggtggtgatcagccagatcactaaaggtcaagcacttctgtctccccggtcaacgctgatatgctccgccagggcaaaaacagctgcgatcgttatccgcaaagtgcctacgcaaagcctagtaatatcttgaatgatatatggttggtcgttcagctaaaccccatagtagacctggcagatgaggctggaaataccccactggtgacagtgttccagcctgcgtggctgcctgcgcactcttgcgagtgcgaagccatatatttgacaaggtgtgaagagccccgtgtgctcactttgagtcctccggcccctgaatgtggctaaccttaaccctgcagctagtgcatacaatccagtgtgtggctagtcgtaatgagcaattgcgggatgggaccaactactttgggtgtccgtgtttcactttttcctttataatttgcttatggtgacagtatatagcttatatattgttacc

SEQ ID NO: 685 - DNA, 612 bp, Human rhinovirus
  C3, strain HRV-QPM, complete genome.1
ttaaagctggatcatggttgttcccaccatgattacccacgcggtgcagtggtcttgtattacggtacatttccataccagttttatacaccccaccccgaaactcatagaagtttgtacacaatgaccaataggtggtggccatccaggtcgctaatggtcaagcacttctgtttccccggcacccttgtatacgcttcacccgaggcgaaaaatgaggttgtcgttatccgcaaagtgcctacgaaaagcctagtaacactttgaaaacccatggttggtcgctcagctgtttacccaacagtagacctggcagatgaggctagacattccccaccagcgatggtggtctagcctgcgtggctgcctgcacaccctgccgggtgtgaagccagaaagtggacaaggtgtgaagagcctattgtgctcactttgagtcctccggcccctgaatgtggctaaccctaaccccgtagctgttgcatgtaacccaacatgtatgcagtcgtaatgggcaactatgggatgggaccaactactttgggtgtccgtgtttcctgttttactttttcattgcttatggtgacaattgtatctgatacacttgttacc

SEQ ID NO: 686 - DNA, 612 bp, Human rhinovirus
  44, complete genome.1
ttaaaactgggtccaggttgttcccacctggatctcctacatggagttgtactctattatcccggtaatcttgtacgccagttttatatcccttccctttttgtaacttagaagttaaacacacagaccaataggtggtggctatccaagtcattaatggtcaagcacttctgtttccccggtttagattgatacgctccaccagggcgaaaacaatttaaatcgttatccgcaaaatgactacgcaaagcctagtaatatcttgaaggacttatggttggtcgctccactaaaccccatagtagacctggcagatgaggctagaaataccccactggagacagtgttctagcctgcgtggctgcctgcacaccctatgggtgtgaagccatactttcgacaaggtgtgaagagccccgtgtgctcattttgagtcctccggcccctgaatgtggctaaccttaaccctgcagctagtgcatgcaatccagcatgttgctagtcgtaacgagcaattgcgggatgggaccaactactttgggtgtccgtgtttcactttttccttttatttgcttatggtgacaatatatatagtacatatatattggcatc

SEQ ID NO: 687 - DNA, 613 bp, Human rhinovirus
  9, isolate F01, complete genome.1
ttaaaactggatctgggttgttcccactcaggtctcccacgtggagtagtacactgttattacggtaactttgtacgccagttttacatcccctccccccaagtaacttagaagataagcacacaggccaataggagatgatcagccagatcattatgggccaagcacttctgtttccccggtcgaagttgatatgctccaacagggcaaaaacaactgagatcgttatccgcaaagcgcctacgcaaagcctagtaactatctggaaattacttggttggtcgctccgccataccccatggtagacctggcagatgaggctagaaattccccactggcgacagtgttctagcctgcgtggctgcctgcacaccctttttgggtgtgaagccaagtaatggacagggtgtgaagagccccgtgtgctcgctttgagtcctccggcccctgaatgtggctaaccttaaccccgcagctagagcacacaacccagtgtgtatctagtcgtaatgagcaattgcgggatgggaccaactactttgggtgtccgtgtttcttgtttttcttttatatttgcttatggtgacaatatatagtgatatatattggcatc

SEQ ID NO: 688 - DNA, 613 bp, Human rhinovirus
  12, complete genome.1
ttcaaactgggttgtggttgatcccaccacaactgctcactgagcgtagtgctctcatattccggtatgcttgcacgccagttttactcccctcccctcattgtaacttagaagcaaagcacacctgatcaataggagataacttgccaggttatctaagatcaagcacttctgtttccccggcaagtgtgaatatgctttacccaaggcaaaagctgatcttgtcgttatccgcaaggtgcctacgagaagcctagtaatgctcaagatgtggtttgactggtcgctccgctgttccccacagtagacctggcagatgaggctggacattccccaccagcgatggtggtccagcctgcgtggctgcctgcacaccctatgggtgtgaagccaaatttactgacagggtgtgaagagcctattgtgctcaccttgattcctccggcccctgaatgtggctaatcctaaccccgctgctattgcacacgaaccagtgtgtagatagtcgtaatgagcaatagtgggatggaaccaactactttgggtgtccgtgtttcttgtttttctttatttgtcttatggtcacaatatatatataacgtatattgtgatc

SEQ ID NO: 689 - DNA, 613 bp, Rhinovirus C
  strain 20692_83a_HRV-C polyprotein gene, complete cds.1
tgtggttgtacccaccaccgggcatactgtgcgtggtacactgtgattccggtcaccttgtacgcctgtttgctaccctaccccaactttctttcgttctttacttccagtaacttagaagttgacacagagtccaataggatgcagctaatccaagtctgccacggacaagcacttctgtttccccgggtgtgtgaatagactccaacagggttgaagctgtagcactcgttatccgcataactaccacgcgaatgttagtaacaccctctaggtatagtgggatttcgctccgcagaaaccccatctgtagattagggcaatgaggctacacggaccccactggcgacagtggtgtagcctgcgtggtgccctacctggggtttcataccccaggattccactttactgacagggtgtgaaggcgctagtgtgctagttgtgagtcctccggtccctgaatgtggctaatcctaaccccgtggccatttcatgtaaaccaacatgcaggtggtcgtaacgagtaatcacgggatggaaccaactactttgggtaaccgtgtttcctgttttactttaatgtgtgtcttatggttacaactatagagtaacc

SEQ ID NO: 690 - DNA, 614 bp, Human rhinovirus
  64, complete genome.1
ttcaaactggatctgggttgttcccacccagatcacccaagtggtgtagtactctgtcattccggtgactttgtacgccagtttttacaccccccccttcttgtaacttagaagaattaagttcagaccaataggaaaacgacaaaccagtcgtttaaggtcaagcacttctgtttccccggtcaatgctgatatgcttcaccaaggcaaaaacagcagcgatcgttacccgcaagacgcctacgcaaagcctagtaatgcctttgaagatatttgtctggtcactcaggtacaatcccagtactagacctggcagatgaggctggaaaatccccactggcgacagtgttccagcctgcgtggctgcctgcacacccatacgggtgtgaagccaaatattggacaaggtgtgaagagccccgtgtgctcgtcttgagtcctccggcccctgaatgcggctaaccttaaccccacagccattgcttgcattccagcaagtctatggtcgtaatgagcaattgtgggatgggaccgactactttgggtgtccgtgtttcactttttaccttttattatgcttatggtgacaatatatagcgttatatattggcatc

SEQ ID NO: 691 - DNA, 614 bp, Human rhinovirus
  A22, strain HRV-A22/Lancaster/2015, complete1
cacttgggtgatctgggtgggaacaacccagatcccccaagtggtgtagtgctctgttattccggtaaccttgcacgccagttttatcacccctttccccatgtaacttagaagttttaaacacagaccaatagggagcgacaaaccagtcgtgaaaggtcaagcacttctgtttccccggtcaacgttgatatgctctcccagggcaaaaacaacagcgatcgttacccgcaagatgcctacgcaaagcttagtaacgccctcgaagatactcggttggtcgttcatgtgcaaccccagcattagacctggcagatgaggctagaaattccccactggcgacagtgttctagcctgcgtggctgcctgcacaccctgacgggtgtgaagcctagtattggacaaggtgtgaagagccccgtgtgctcatcttgagtcctccggcccctgaatgcggctaaccttaaacctgcagccattgctcacaatccagtgagtttgtggtcgtaatgagcaattgcgggatgggaccgactactttgggtgtccgtgtttctctttttaccttacattttagcttatggtgacaatatatagtgatatatattggcatc

SEQ ID NO: 692 - DNA, 614 bp, Rhinovirus C
  isolate 7383-MY-10, complete genome.1
ttaaaactgaaccatggttgttcccaccatggttacccacgtggtgcagtggacttgtattacggtacatttccataccagttttataacccctaccctgaaacttttagaagcatgtacacatacagaccaacaggtggcaatcagccagattgctaacggtcaagcacttctgtttccccggtaatcttgcatacgcttcacccgaggcgaaaagtgagattatcgttatccgcaaagtgcctacgagaagcccagtagcacattgaaagcctatggttggtcgctcagctgttcacccaacagtagacctggcagatgaggctagatattccccaccagcgatggtgatctagcctgcgtggctgcctgcacaccctatcgggtgtgaagccagaaagtggacaaggtgtgaagagcctattgtgctcactttgagtcctccggcccctgaatgtggctaatcctaaccccgtagctgttgcatgtaacccaacatgtctgcagtcgtaatgggcaactacgggatggaaccaactactttgggtgtccgtgtttcttgtttttctttatatttgcttatggtgacaattgtagatactacacttgttacc

SEQ ID NO: 693 - DNA, 615 bp, Unknown
  Description of Unknown: Human coxsackievirus A16, strain shzh99-79 polyprotein gene, partial1 sequence
cgaccaatagtgggcgtgacgcaccagtcacgtcttggtcaagcacttctgtttccccggaccgagtatcaatagactgcttacgcggttgaaggagaaaacgttcgttacccggctaactacttcgagaaacctagtagcaccatgaaagttgcagagtgtttcgctcagcacttcccccgtgtagatcaggtcgatgagccactgtgaaccccacgggcgaccgtgacagtggctgcgttggcggcctgcccatggggcaacccgtgggacgctctaatacagacatggtgtgaagagtctattgagctagttagtaatcctccggcccctgaatgcggctaatcctaactgcggagcacgcaccctcaatccagggggcagtgtgtcgtaacgggtaactctgcagcggaaccgactactttgggtgtccgtgtttccttttattccttactggctgcttatggtgacaatcaaagagttgttaccatatagctattggattggccatccggtgtctaacagagctattgtctacctgttcattggatacgtccctctcaattacaagactctccaaactcttaactacatactgctacttaatcataagaa

SEQ ID NO: 694 - DNA, 615 bp, Human rhinovirus
  41, complete genome.1
ttaaaactgggtttgggttgatcccacccaaaccacccacgtggtgtagtacactgttatctcggtaactttgtacgccagttttatctccccctcccccctttgtaacttagaagtcatgcacaatgaccaatagcaggcaatcatccagattgtcatcggtcaagtacttctgtttccccggttcagattgatatgctccaacagggcaaaaacaacctggatcgttatccgcaagatgcctacgcagaacctagtatcacactggaagattctcggttggtcgctcagttacaaccccagtaacagacctggcagatgaggctagaaattccccactggcgacagtgttctagcctgcgtggctgcctgcacacccgtttgggtgtgaagcctagaattggacagggtgcgaagagtcgagtgtgctcatcttgagtcctccggcccctgaatgcggctaaccctaaccctgcagccattgcccacaaaccagtgggtctatggttgtaatgagcaattgcgggatgggaccgactactttgggtgtccgtgtttcactttttacttattatttgcttatggtgacaatatatagatacatatattgacacc

SEQ ID NO: 695 - DNA, 615 bp, Human rhinovirus
  73, complete genome.1
ttaaaactgggtttgggttgttcccacccaaaccacccacgcggtgttgtacactgttattccggtaaccttgtacgccagttttatatcccttcccccccttgtaacttagaagacatgcgaatcgaccaatagcaggcaatcaaccagattgtcaccggtcaagcacttctgtttccccggctctcgttgatatgctccaacagggcaaaaacaattggagtcgttacccgcaagatgcctacgcaaaacctagtagcatcttcgaagatttttggttggtcgctcagttgctaccccagcaatagacctggcagatgaggctagaaataccccactggtgacagtgttctagcctgcgtggctgcctgcacacccacacgggtgtgaagccaaagattggacaaggtgtgaagagtcacgtgtgctcatcttgagtcctccggcccctgaatgcggctaaccttaaccccgtagccattgctcgcaatccagcgagtatatggtcgtaatgagtaattacgggatgggaccgactactttgggtgtccgtgtttcactttttacttatcaatttgcttatggtgacaatatatatagatatatattgacacc

SEQ ID NO: 696 - DNA, 615 bp, Human rhinovirus
  15, complete genome.1
ttaaaactgggttcaggttgatcccacctgaacctcccaagcggagtagtactctgttatttcggtaactttgtacgccagttttatatccccctccccatgtaacttagaagatgagctcacagaccaatagccggcaatcatccagattgtcaatggtcaagcacttctgtttccccggtcaacgttgatatgctccaacagggcaaaaacaactgagatcgttatccgcaaagtgcctacgcaaagcctagtaatgctttcgaagtcatttggttggtcgctccgctgtaacccacagtagacctggcagatgaggctagaaactccccactggcgacagtgttctagcctgcgtggctgcctgcacaccctttgggtgtgaagccaaattacggacaaggtgtgaagagccccgtgtgctcactttgagtcctccggcccctgaatgtggctaaccttaaccctgcagctagagtgcacaatccagtgtatttctagtcgtaatgagcaattgcgggatgggaccaactactttgggtgtccgtgtttcactttctttttttatcttttatttgcttatggtgacaatatattgaattatatattgacacc

SEQ ID NO: 697 - DNA, 615 bp, Human rhinovirus
  94, complete genome.1
ttcaaactggatctgggttgttcccacccagatcacccaagaggtgtagtgctctgtcattccggtgaccttgcacgccagttttatcaccccttccctcttgtaacttagaagaattaaactcagaccaataggaagcgacaagccagtcgtgacaggtcaagcacttctgtttccccggtcaaagttgatatgcttcaccaaggcaaaaacaacagcgatcgttatccgcaagatgcctacgcaaagcctagtagtgcctttgaaaatatttgtctggttgctcaagtacaaccccagtactaaacctggcagatgaggctggagcttccccactggtaacagtgttccagcctgcgtggctgcctgcacacccttacgggtgtgaagccaaatattggacaaggtgtgaagagccccgtgtgctcatcttgagtcctccggcccctgaatgcggctaaccttaaccccacagccattgctcacaatccagtgagtgtatggtcgtaacgagcaattgtgggatgggaccgactactttgggtgtccgtgtttctcttttttcctttttaattctgcttatggtgacaatatatagtgttatatattggcatc

SEQ ID NO: 698 - DNA, 615 bp, Human rhinovirus A
  isolate hrv-A101, complete genome.1
ttaaaactggatcatggttgttcccaccatgattacctacgggtgtagtatacttgtatcccggtacatttatacgccagttttataacccccaccccaaatgtaacttagaagcatgtacacaatgatcaatagggtggtggctatccaagtcatctaagatcaagcacttctgtctccccggtgagtgtgaatatgctttacccaaggcaaaagctaatctcatcgttatccgcaaggtgcctacgggaagcctagtaacattctgaagatattttggttggtcgatcagttgcactcacccatgcaatagacctggcagatggggctaggcatacctcactggtaacagtggcctagcccgcgtggctgcctgcacaccttcgggtgtgaagccataatattgacagggtgcgaagagcctactgtgctcaccttgagtcctccggcccctgaatgtggctaatcctaaccccgtatccattgcacacaaaccagtgtgtctatggtcgtaatgggtaactacgggatggaaccaactactttgggtgtccgtgtttcttgtttttctttaatactgcttatggtgacattatatattgatatagtgtcatc

SEQ ID NO: 699 - DNA, 615 bp, Rhinovirus C
  isolate 8713-MY-10, complete genome.1
ttaaaactgggcaggagttgttcccactcttgccacccacagggtgtggtgctcttgtattacggtacacttgcatgccagttttatctcccccctccccacaatgtaatttagaagccaatcacatgaccaataggaagtggtaagccataccacttaaggtcaagcacttctgtttccccggtatgcgtggaataggcctcttaaggggctgaagccacaattatcgttacccgcatgtgaactacgcgaaacctagtactaccttgaaagtacattgtctggtcgctcagccaatccccatggtagacctggcagatgaggcaagaggtaccccactggtaacagtgttcttgcctgcgtggctgcctgcacacccttaccgggtgtgaagccaatgtatagacagggtgagaagagtcgagtgtgcttcacatgagtcctccggcccctgaatgcggctaatccaaccccgcagctgtagtatgcaagccagcatatgtgcagtcgtaatgggtaactgcgggacggaaccgactactttgggtgtccgtgtttcctgtttttcctttattcatgcttatggtgacaatattgagaattaatattgtcact

SEQ ID NO: 700 - DNA, 615 bp, Human rhinovirus
  49, isolate F04, complete genome.1
ttaaaactggatctgggttgttcccacttggatctcccaaagggagtggtactctgttattacggtaactttgtacgccagttttatcctccccttaccccatgtaacttagaagtttttcataaagaccaatagttggtaatcatccagattacttaaggtcaagcacttctgtttccccggtcaatgttgatatgctccaacagggcaaaaacaactgcgatcgttatccgcaaagcgcctacgcaaagcttagtagcacctttgagattgtttggttggtcgttccgccatttcccctggtagacctggcagatgaggctagaagtaccccactggcgacagtgttctagcctgcgtggctgcctgcacaccctgtgggtgtgaagccaaataatggacaaggtgtgaagagccccgtgtgctcgctttgagtcctccggcccctgaatgcggctaaccttaaccctgcagctagagcatacaaaccagtgtgtatctagtcgtaatgagcaattgcgggatgggaccgactactttgggtgtccgtgtttcactttttttttacttataattgcttatggtgacaatatatatatagtatatattgacacc

SEQ ID NO: 701 - DNA, 616 bp, Human rhinovirus
  13, isolate F03, complete genome.1
ttaaaactgggtctgggttgttcccacccaaaccacccacgcggtgtagtacactgttattccggtaactttgtacgccagttttatatccccaccccccttttgtaacttagaagttatgcacactgaccaatagtgggcaatcatccagattgtcatcggtcgagcacttctgtttccccggtttgagttgatatgctccaccagggcaaaaacaactcagatcgttatccgcaagatgcctacacagaacttagtaccattctggaaaattcttggctggtcgttcaattactaccccagtaatagacctggcagatgaggctagaagttccccactggcgacagtgttctagcctgcgtggctgcctgcacacccttctggggtgtgaagcctagaattggacagggtgtgaagagtcgcgtgtgctcatcttgagtcctccggcccctgaatgcggctaaccctaaccctgcagccattgcccacaatccagtgggtttatggtcgtaatgagcaattgcgggatgggaccgactactttgggtgtccgtgtttcactttttacttattatttgcttatggtgacaatatatagatacatatattgacacc

SEQ ID NO: 702 - DNA, 616 bp, Human rhinovirus
  36, complete genome.1
ttaaaactgggagtgggttgttcccactcactccacccatgcggtgttgtacactgttattacggtaaccttgtacgccagttttgccacccttccccattatgtaacttagaagtttgtacaacaagaccaataggtgataattatccagattatcaaaggtcaagcacttctgtttccccggtcgatgaggatatgctttacccaaggcaaaaaccttaaagatcgttatccccacactgcctacacagagcctagtaccacttttgatgtaattaggttggtcgctccctgcaaacccagcagtagacctggcagatgaggctggacactccccactggtgacagtggtccagcctgcgtggctgcctgctcaccctattgggtgagaagcctacttattgacaagatgtgaagagccgcgtgtgctcagtgtgcttcctccggcccctgaatgtggctaaccttaaccctgcagccgctgcccataatccaatgggtttacggtcgcaacgcgcaagtgcgggatgggaccaactactttgggtgtccgtgtttcctatttttcttttatttgcattttatggtgacaatttatagtatatagattgtcgtc

SEQ ID NO: 703 - DNA, 616 bp, Human rhinovirus
  66, strain ATCC VR-1176, complete genome.1
ttaaaactggatctaggttgttcccacctagatctcccatgtggagtagtactctattattacggtaattttgtacgccagttttatatccccttccccttttgtaacttagaagtcgtgaacacagaccaataggtggcgatcacccagatcgcttaaggtcaagcacttctgtttccccggtcaacgttgatatgctccaccagggcaaaaacaacggagatcgttatccgcaaggtgcctacgcaaagcctagtaacctcttggaggatatatggttggtcgctcagctataccccatagtagacctggcagatgaggctagaaactccccactggcgacagtgttctagcctgcgtggctgcctgcgcactcttatgagtgcgaagccatatatttgacaaggtgtgaagagccccgtgtgctcaccttgagtcctccggcccctgaatgtggctaaccctaaccctgcagctagtgcatgaaatccatcatgttgctagtcgtaatgagcaattgcgggatgggaccaactactttgggtgtccgtgtttcactttttccttttatatttgcttatggtgacaatatatatataacatatatattggcatc

SEQ ID NO: 704 - DNA, 616 bp, Human rhinovirus
  90, strain ATCC VR-1291, complete genome.1
ttaaaactgggttcaggttgttcccacctgaatctcctacatggagttgtactctattatcccggtaattttgtacgccagttttatcctcccctccccatgtaacttagaagctgtacacaacgaccaacaggtaacattcatccagagtgttaaaggtcaagcacttctgtttccccggtcaaagttgatatgctccaacagggcaaaaacaactgcgatcgttatccgcagagcaactacgcaaagcttagtaccactttcaatggtgtatggctggtcgctccactataaacccaatagtagacctggcagatgaggctagaaactccccactggtaacagtgttctagcctgcgtggctgcctgcgtgcccttttgggcacgaagccttacatttgacaaggtgcgaagagccccgtgtgcttgctttgagtcctccggcccctgaatgtggctaaccttaaccctgcagctagtgtgtgcaatccagcacatggctagtcgtaatgagcaattgcgggatgggaccaactactttgggtgtccgtgtttcttgtttttcttttatatttgcttatggtgacaatatatatagaatatatatattggcatc

SEQ ID NO: 705 - DNA, 616 bp, Human rhinovirus C
  strain 025, complete genome.1
ttaaaactgggtacaggttgttcccacctgtaccacccaagtggtgtagtgctcttgtattccggtacatttgcacgccagtttgccacccctaccctctatgtaacttagaagcttacacaaagaccaataggcggtggtaaacccataccactaacggtcaaacacttctgtttccccggcatatgaggaataggctccaaaagggctgaagccactagtgtcgttatccgcattggtactacgcaaagcctagtatcggcctgaaaatttcttggttggtcgttcggccagttaccccactggtagacctggcagatgaggcaggacttaccccactggcgacagtggtcctgcctgcgtggctgcctgcacacccttatggggtgtgaagcctaggaacggacagggtgtgaagagccccgtgtgctaccaatgagtcctccggcccctgaatgcggctaatcttaccccgcagctgttgcacacaatccagtgtgtatgcagtcgtaatgagcaattgtgggatggaaccgactactttgggtgtccgtgtttccttgttttccttatatttgcttatggtgacaatattgatattatcagtgttgtcatc

SEQ ID NO: 706 - DNA, 617 bp, Theiler's disease-associated virus
  isolate HorseA1_serum, complete1
tgataccgtgtcccggtacgacctcgcgcgtccccaagctcgccctgaggggggagcgtaagggcgcgtagtggggtagccccccaaaccgagccaccctagtgagtgactttagaatggttagggagactaccgccttcgctgtttggggacctaatgatccgcgtgccagggttcttcgggtaaatcccggcgcggtgttttgggttcagggcagtaggggcagacgggccagcagtcgctggttcctggtaccaccaccctatccggacgacctccctcacgaaaggtcgccacggtctgtggctcgacgacgcctataattcagtccgaggggcgcagccctcgttaaacttaggcaaggttcctcgccattgatttggccaggggtttaagtgaacgccgcccttttaatgtttaatagggttctttcccggcgggttgacaaacacttccctgggctcttcgttggcctcggttccttgatgcttcggcacccatgagcgcacaggggggggaccctgcgacagtccgccaagaggaaaatccttcgggtgacctcgtgcgcaacccaatcccttcttcttccacatggcgtgtctgtggtgcatgctgtg

SEQ ID NO: 707 - DNA, 617 bp, Human rhinovirus
  96, strain ATCC VR-1296, complete genome.1
ttaaaactgggtctgggttgtccccacctagatcacccaagtggtgtagtacactgttatttcggtaaccttgtacgccagttttataaccccctccccaaatgtaacttagaagctgtacacaacgaccaatagagggtaatcatccagattacttacggtcaagcacttctgtctccccggtttactttgatatgctccaacagggcaaaaacaaagtgaatcgttacccgcaagatgcctacgcaacgcctagtaacatcctgaattgtttatggttggtcgctcaattacaaccccagtaatagacctggcagatgaggctagatattccccactggcgacagtgatctagcctgcgtggctgcctgcacaccccttgtgggtgtgaagccataatcatgacagggtgcgaagagccacgtgtgctcatcttgagtcctccggcccctgaatgcggctaaccctaaccctgcagccattgcctacaaaccagtgggtatgtggtcgtaacgagaaattgcgggatgggaccgactactttgggtgtccgtgtttcactttttaccttatatttgcttatggtgacaatatatacgagtttatatattgacacc

SEQ ID NO: 708 - DNA, 617 bp, Rhinovirus C
  isolate 3805-MY-10, complete genome.1
ttaaaactgagtgtgggttgcacccacccacactgtctacggacgttgtacacttgtatcccggtacatttgtacgccagtttgcctccccttccctttatgtaacgtaagaagcctcagcacaatggccaacaggtggtaacaatccatgttacctacggtcaagcacttctgtctccccggtacgaagagtgttaagtcttacccaagaccgaagctttgagtatcgttatccgcataactactggacaaagcccagtaacaccccacgatgtaggatggttggtcgttccaccagtgtaaccccctggtagacctggcagatgaggctagagtttccccactggtgacagtgttctagcctgcgtggctgcctgctcccttatgggagaagccattctattgacaaggtgtgaagagccccgtgcgctagttatgagtcctccggcccctgaatgcggctaatccaaccctgcagccattgcatggaaaccaccatgtagatggtcgtaatgagcaattgcgggacggaaccgactactttgggtgtccgtgtttcttgtttttcttatcaattgcttatggtgacaatatatacagctaatatattgttcacc

SEQ ID NO: 709 - DNA, 617 bp, Human rhinovirus
  81, isolate F06, complete genome.1
ttaaaactggatctgggttgttcccacccagatcacctacatggtgttgtacactattattacggtaattttgtacgccagttttatatccccttccccaaatgtaacttagaagcaatgcaaactgatcaatagggggcaatcatccagattgctaatgatcaagcacttctgtttccccggtcaaggttgatatgctccacaagggcaaaaacaaccgagatcgttatccacaagatgcctacgcaaagcctagtaatgcttttgaagatacttggttggtcgctcagctgtgcacccgacagtagacctggcagatgaggctagaagtacccctctggcgacagagttctagcctgcgtggctgcctgcacacccttttgggtgtgaagccaagtattggacaaggtgtgaagagccccgtgtgctcatcttgaatcctccggcccctgaatgtggctaaccttaaacctgcagccagtgcacacaaaccagtgtgtagctggtcgtaatgagcaattgcgggatgggaccaactactttgggtgtccgtgtttcactttttacctttatattgcttatggtgacaatatatatagcacatatatattgttatc

SEQ ID NO: 710 - DNA, 617 bp, Human rhinovirus C
  strain WA823M02, complete genome.1
ttaaaactgaatcatggttgttcccaccatgattgtctactggacgttgtactcttgtattccggtacacttgtacgccagttttataaccccttcccctttgcaacttagaagaaagtaaacactggccaataggaaatagcaaaccacgctatttacggtcaagcacttctgtttccccggtctgacgggatatgcttcacccgaggcagaaactcagatgatcgttatccgcaaagtgcctacgggaagcctagtagcactttggaagttgttgggctggtcgctcaattgctgaccccgagcaatagacttggcagatgaggctggacgtgccccaccagtgatggtggtccagcctgcgtggctgcctactcaccctaacagggtgagaagcctatcaatagacaaggtgtgaagagcctactgtgctcactttgattcctccggcccctgaatgtggctaatcctaaccccgtatctatcgcatgcacaccagcatgtaggtagtcgtaatgggcaactacgggacggaaccaactactttgggtgtccgtgtttccttgttcttttattacttgcgtatggtgacaattgtatgaaatacgattgacacc

SEQ ID NO: 711 - DNA, 618 bp, Unknown
  Description of Unknown: Human rhinovirus type 89 (HRV89), complete genome.1 sequence
ttaaaactgggagtgggttgttcccactcactccacccatgcggtgttgtactctgttattacggtaactttgtacgccagtttttcccacccttccccataatgtaacttagaagtttgtacaatatgaccaataggtgacaatcatccagactgtcaaaggtcaagcacttctgtttccccggtcaatgaggatatgctttacccaaggcaaaaaccttagagatcgttatccccacactgcctacacagagcccagtaccatttttgatataattgggttggtcgctccctgcaaacccagcagtagacctggcagatgaggctggacattccccactggcgacagtggtccagcctgcgtggctgcctgctcacccttcttgggtgagaagcctaattattgacaaggtgtgaagagccgcgtgtgctcagtgtgcttcctccggcccctgaatgtggctaaccttaaccctgcagccgttgcccataatccaatgggtttgcggtcgtaatgcgtaagtgcgggatgggaccaactactttgggtgtccgtgtttcctgtttttcttttgattgcattttatggtgacaatttatagtgtatagattgtcatc

SEQ ID NO: 712 - DNA, 618 bp, Human rhinovirus
  7, complete genome.1
ttaaaactgggagtgggtgttcccactcactccacccacgtggtgctgtacactgttattccggtaactttgtacgccagtttttccctcccttccctcattatgtaacttagaagcatgaacatatggaccaataggcaataatcatccagattattgaaggtcaagcacttctgtttccccggtcaataaagatatgctttacccaaggcaaaaacttttgagatcgttacccgcacatcaactacgcaaagcctagtatcacctttgatgtactaagactggtcgtttcctgcaaccccagcagtagacctggcagatgaggctggacgtaccccactggcgacagtggtccagcctgcgtggctgcctgctcgcccatatgggcgagaagccttattattgacaaggtgtgaagagccgcgtgtgcttggtgtgagtcctccggcccctgaatgtggctaaccttaaccctgcagccattgctcataatccaatgagttagtggtcgtaatgcgcaagtgcgggatgggaccaactactttgggtgtccgtgtttcttattttttctttcatgtgtgttatatggtgacaatttatagtatataagttgtcatc

SEQ ID NO: 713 - DNA, 618 bp, Human rhinovirus
  63, strain ATCC VR-1173, complete genome.1
ttaaaactgggtccaggttgttcccacctggacctcctaagtggagtggtacactattattccggtaattttgtacgccagttttatctccccaccccccttttgtaatttagaagttatgaacacagaccaataggtggcaactagccaagttgttaaaggtcaagcacttctgtctccccggctgacgttgatatgctccaacagggcaaaaacaatgaaagtcgttatccgcaaagtgcctacgcaaagcctagtaacactttgaaatgtctatggttggtcgctcagctattccccatagtagacctggcagatgaggctagaaataccccactggtaacagtgttctagcctgcgtggctgcctgcgcaccctccccgggtgcgaagccatatatatgacaaggtgcgaagagccccgtgtgctcactttgaatcctccggctcctgaatgtggctaaccttaaccccgcagccagtgcacataagccaatgtgtggctggtcgtaatgagcaattgtgggatgggaccaactactttggatgtccgtgtttcctgtttttcttttattcttgcttatggtgacaatatatatagtttatatatattggcatc

SEQ ID NO: 714 - DNA, 618 bp, Human rhinovirus
  C11, strain CL-170085, complete genome.1
ttaaaactggatacaggttgttcccacctgtatcacccaagtggtgtggtgctcttgtatttcggtacgtttgcacgccagtttgctaccccttcccttttacgtaacttagaagtttacacaaagaccaataggcggtggtaaatccataccactaacggtcaaatacttctgtttccccggcatgcgaggaataggctccaaaagggctgaagccactagtgtcgttatccgcattggtactacgcaaagcctagtattaccttgaaaatttcttggctggtcgctccaccagataccccactggtagacctggcagatgaggcaggacttaccccactggcgacagtggtcctgcctgcgtggctgcctgcacaccccttacggggtgtgaagcccagaaacagacaaggtgtgaagagccccgtgtgctactagtgagtcctccggcccctgaatgcggctaatcttaccccacagctgttgcacgcaaaccagcgtgtatgcagtcgtaatgagcaattgtgggatggaaccgactactttgggtgtccgtgtttctttttattcctattatttgcttatggtgacaatattgatattatcagtgttgtcatc

SEQ ID NO: 715 - DNA, 619 bp, Bat picornavirus
  isolate BtRs-PicoV/YN2010 polyprotein gene,1
tttcaaaaggccctgggcatacggcgttattcgtaacgtcgtatgtccagggcggtagcatcaggccaaggcctgatgctaccacgtgtggactaaaccacacactcttcttgtgacacgttgtgtcacctatccctttcttggtaacttagaagcttgtacacttacgcacgtaggtgccccacatccagtggggtttgtgcaaagcaatcttgttccccggtaaaccctgataggctgtaaccacggccgaaacaaggtttgtcgttacccgactcactactacacaaagcctagtaaagttcaatgaaagtgcgcagcgtgatccggtcaaaacccccttgaccagaaacacatgatgagggtcaccaacccccactggcgacagtgtggtgtccctgcgttggcatgtggcctcgtagaggcgttgcaatctggatttgctccgaagagccccgtgtgctagtgtttatacctccggccccttgaatgcggctaatcctaacccccgagcatgtacacacaagccagtgtgtagcatgtcgtaatgagcaatttggggatggaaccgactactttagggtgtccgtgtttctcattattctttgtttgatgtttt

SEQ ID NO: 716 - DNA, 619 bp, Echovirus
  E9, strain USA/CA/RGDS-2017-1011, complete genome.1
cacacggtcaatagataactcagcaaaccagctgggtcttgaccaagcacttctgttaccccggactgagtatcaataagctgctcgcgcggctgagggagaaaacgtccgttacccggccaattacttcgagaaacccagtatcaccatgaaggttgcgcagcgtttcgttccgcacaaccctagtgtagatcaggtcgatgagccaccgcgttccccacgggcgaccgtggcggtggctgcgctggcggcctgcccatggggtgacccatgggacgcttcaacactgacatggtgcgaagagtctattgagctaattggtaatcctccggcccctgaatgcggctaatcctaactgcggagcagatacccacacaccagtgggcagtctgtcgtaatgggcaactctgcagcggaaccgactactttgggtgtccgtgtttcctcttattcttgattggctgcttatggtgacaattgggagattgttaccatatagctattggattggccatccagtgacaaacagagcaattatctactcgttcattggttttgtgccactgaattataaggttttaatcaccctcaaattcatattagcactcaacacatcaaa

SEQ ID NO: 717 - DNA, 619 bp, Human rhinovirus
  33, strain ATCC VR-330, complete genome.1
ttaaaactggatctaggttgttcccacctagatctcctacacggagttgtactctgttattccggtaactttgtacgccagttttatacccccttccccctttgtaacttagaagctgaacatactgaccaataggcggcattcaaccagaatgtcaaaggtcaagcacttctgtttccccggttaaagctgatatgctccaacagggcaaaaacagccttaatcgttatccgcaagacaactacgcaaagcctagtatcatctttgaaagtatgtggttggtcgctccgctataaactcaatagcagacctggcagatgaggctagaaactccccactggcgacagtgttctagcctgcgcggctgcctgcgtgccctatacgggtacgaagccatatatttgacaaggtgtgaagagccccgtgtgcttgtcttgagtcctccggcccctgaatgtggctaaccttaaccctgcagctggtatgcacaatccagtacatggccagtcgtaatgagcaattgcgggatgggaccaactactttgggtgtccgtgtttcctattttacctttatatttgcttatggtgacaatatatatataacatatatattggcatc

SEQ ID NO: 718 - DNA, 619 bp, Human rhinovirus
  A61, strain SC628, complete genome.1
ttaaaactgggtctgggttgtccccacccagaccacccacgtggtgttgtacactgttattccggtaactttgtacgccagttttgaactccccttaccccttttgtaacttagaagttaaacaaaccgaccgatagcaggcaatcacccagattgcttatggtcaagcacttctgtctccccggtctcctttgatatgctccaccagggcaaaaacagagtagatcgttatccgcaagatgcctacgcaacgcctagtagcattttgaagtaattttggctggtcgctcatttacaaccccagtaatagacctggcagatgaggctagatactccccactggtgacagtgatctagcctgcgtggctgcctgcacaccctttccgggtgtgaagccaaacttatgacaaggtgtgaagagccacgtgtgctcatcttgagtcctccggcccctgaatgcggctaaccttaaccctgcagccattgcctacaagccagtgggtatgtggtcgtaatgagaaattgcgggatgggaccgactactttgggtgtccgtgtttcactttttaccttatatttgcttatggtgacaatatatatatagatatatattgacacc

SEQ ID NO: 719 - DNA, 619 bp, Human rhinovirus C
  isolate N4, complete genome.1
ttaaaactgagtatgggttgttcccacccatactgcctacgggcgtagtactcttgtgctccggtacatttgtacgccagtttttcacccccaccccctaggtaactcttagaagcacttgcacacagacgaataggcagccaacactccacgttggtcaacgtcaagcacttctgtttccccggtattaggggttaggcttttcaagaggctgaagcctgaagtatcgttacccgcgcaattactaagcagagcctagtatcacttcgacccttccactggctggtcgttcaatgagaaaacccactcatagacctggcagatggggctggaaataccccactggcgacagtgttccagcccgcgtggctgcctgtcccccattttgggggaaagccaatgtaaggacaaggtgtgaagagccgcgtttgctaattgtgagtcctccggcccctgaatgcggctaatcttaccccacagctattgcatggaagccaccatgtggatagtcgtaacgggcaactgtgggacggaaccgactactttgggtgtccgtgtttccttttattccatttattatctcatggtgacaacgtatacagattatatgttgtttacc

SEQ ID NO: 720 - DNA, 620 bp, Human rhinovirus
  69, strain ATCC VR-1179, complete genome.1
ttaaaacagcggatgggtatcccaccatccgacccactgggtgtagtactctggtactttgtacctttgtacgcctgtttctccctcccttcccaacctaaacaatccttgtaacttagaaggtttcgattatcgcacaatagggactattgcaaccagcaatagtcagtgcaagcacttctgtttccccggagcggagtgtagatggccaccgctgtcaaaagctcttaaccgttatccgccagttaactacgcaacggctagtagtgccttgttgcttttatggcgttcgatcaggcgagatttaccccctcgctagtctggtcgatgaggctgagaattccccacgggcgaccgtgtctcagcctgcgtggcggccagcccagcctttgctgggacgccttgattgcgacatggtgtgaagacccgcgtgtgcttaactgtgagtcctccggcccctgaatgcggctaacctaaaccctggagccttgaaacacaacccagtgttcgcaaggtcgtaacgagcaattccgggacgggaccgactactttgggtgtccgtgtttcctttattctttcaattgttcttatggtcacaatataagtgttatattgtgatc

SEQ ID NO: 721 - DNA, 620 bp, Human rhinovirus A
  complete genome.1
ttaaaactgggagtgagttgtccccactcactctacccacgcggtgttgtacactgttattacggtaactttgtatgccagtttttgttcccctatccccctttaaagtaacttagaagcatgaacttacagaccaaaaggtgatgatcacccagatcattaaaggtcaagcacttctgtttccccggtcaatgttgatatgcttcaacaaggcaaaaacaacagcgatcgttatccgcaagatgcctacacaaagcttagtacctcctttgatggtatttgtctggtcgctcaggtgtttccccaacactagacctggcagatgaggctagaaactccccactggcgacagtgttctagcctgcgtggctgcctgcacaccctttcgggtgtgaagccaaatactggacaaggtgcgaagagccccgtgtgctcatcttgagtcctccggcccctgaatgcggctaaccttaaacccgcagccattactcacaatccagtgagcagatggtcgtaatgagcaattgtgggatgggaccgactactttgggtgtccgtgtttcatgttttactttatgacttgcttatggtgacaatatatagagatatatattggcatc

SEQ ID NO: 722 - DNA, 620 bp, Rhinovirus C
  isolate 1570-MY-10, complete genome.1
ttaaaactgagtgtgggttgttccccacccacactgtctacgggacgttgtactcttgtattccggtacacttgtacgcccagtttgccaccctaaacaccccgtaacaatagaagtctacgcacacttagaccaatagggggtgttcatccagttcacccaaggtcaagcacttctgtttccccggcataggggtgttaggcttcgcccgaggccaaagctctgattgtcgttatccgcacaactactggacaaagcctagtagcaccctacgatgtagcatggttggttgttccgccagtatcccctggtaaacctggcagatggggctagaagttcctcactggcgacagtgttctagcccgcgtggctgcctgctcccttatgggagaagccattctactgacaaggtgtgaagagccccgtacgctagttgtgattcctccggcccctgaatgcggctaatccaaccctgcagccattacatggaagccaccatgtggatggtcgtaatgagtaattgcgggacggaaccgactactttgggtgtccgtgtttcttgtttttcttttactgacgtttatggtgacaatatatatataacgtatatattgttcatc

SEQ ID NO: 723 - DNA, 621 bp, Moran virus
  polyprotein gene, complete cds.1
gggggctcttcaagcccccccaaccgaattttcttcaacaactactatgtaagttgcattatactctccagatcaattcgaatttgtataatgtactttagtttttgttgtcgactacagtgattataagtaagtagcaatatgtgtccagatcaattcgaatcacaatattgttcattataattgtatgtaggtctcagttgagagaaaaattttgttttgaaaacccagttttttcacaccggaggaatgaatctcaaatcttgggttttcgaggttgtcgtgcggacacttctcgagtagttgaatgatgctgatttgactgctttggaatgttgtcttttgcgatgatgtcggattcacacgggcttcacatgccgagagatggcttcgaacacgctcgtgataatgtcagtggttgcttcgagatttacaaatgtatgcgtacccggaaacagaacttggaaattgatgtcacggtgattgagttctgcacgatggcgatagtacctctttgtactgatcgttgaactggtcaaggcccctgcaggaagtacctgtttcgggctagttgactggcattgagcaccagagtcgaagtttgcccttcaaattgcaaca

SEQ ID NO: 724 - DNA, 621 bp, Human rhinovirus
  103, strain WA327E/09 polyprotein gene, complete1
ttaaaactgagtgtgggttgtccccacccacactgtctacggacgtagtactctcatatcacggtatgtttgtacgccagtttgcctcccctcccaagtgtaacttagaagtttgtactttataaaggccaataggcgggtagtcaaccacactactcatggtcaagcacttctgtttccccggtatgcgaagaataagctttaacaaaggctgaagcttcaattatcgttatccgcatgataactacgcaaagcttagtagcattttgaaagtttattggttggtcgctccactggaaaacccccccagtagacctggcagatgaggctaagtaatccccactggcgacagtgacttagcctgcgtggctgcctgcacacctggagacaggtgtgaagccaagtaatggacaaggtgtgaagagccccgtgtgcttatcatgagtcctccggcccctgaatgcggctaatccaaccccacagctattgcacataatccaatgtgtatttagtcgtaacgggcaactgtgggacggaaccgactactttgggtgtccgtgtttcctttattctcatttaagtttcctatggtgacaaatataagtgattatatctgtcatc

SEQ ID NO: 725 - DNA, 621 bp, Human rhinovirus sp.
  isolate 12MYKLU0081 from Malaysia polyprotein1
tctgcagatatcttaaaactgggttcaggttgttcccacctgaacttcccacgtggagtagtacactattattacggtaattttgtacgccagttttgcttccctccccaatggtaacttagaagatgtacacaacgaccaacaggcggtggttacccaaaccatcaaaggtcaagcacttctgtttccccggtcaacgttgatatgctccaacagggcaaaaacaaccacgatcgttacccgcaagatgcctacgcaaagcctagtaatacactggaagatttatggctggtcgctccactataccccatagtagacctggcagatgaggctagaagtaccccactggcgacagtgttctagcctgcgtggctgcctgcgcaccctatgggtgcgaagccatatattggacagggtgtgaagagccccgtgtgctcatcttgagtcctccggcccctgaatgtggctaaccttaaccccgcagccagagcacgcaatccagtgtgtttctggtcgtaatgagtaattgtgggatgggaccaactactttgggtgtccgtgtttcacttttttcctttattatgcttatggtgacaatatatacacatatatattgacacc

SEQ ID NO: 726 - DNA, 621 bp, Human rhinovirus
  88, complete genome.1
ttaaaactgggagtgagttgtccccactcactctacccacgcggtgttgtacactgttattacggtaactttgtatgccagtttttgttcccctatccccctttaaagtaacttagaagcatgaacttacagaccaaaaggtgatgatcacccagatcattaaaggtcaagcacttctgtttccccggtcaatgaggatatgctttacccaaggcaaaaaccttaaagatcgttatccgcacattaactacgcaaagcctagtatcgcctttgatgtattaagactggtcgttccctgcatacccagcagtagacctggcagatgaagctggacgttccccactggcgacagtggtccagcctgcgtggctgcctgctcacccatttgggtgagaagccttattattgacaaggtgtgaagagccccgtgtgcttaatgtgaatcctccggcccctgaatgtggctaaccttaaccccgcagccgttactcacaatccagtgaaatgacggtcgtaacgcgaaagtgtgggatgggaccaactactttgggtgtccgtgtttcctattttttccttaatgtgtgttatatggtgacaatttatagcgtataagttgtcatc

SEQ ID NO: 727 - DNA, 621 bp, Human rhinovirus
  24, complete genome.1
ttaaaactggatctaggttgttcccacctaaatctcctacatggagttgtactctattattccggtaattttgtacgccagttttatcctcccctccccttaaagtaacttagaagttggacatatcgaccaataggtaacatttatccaaaatgttaaaggtcaagcacttctgtttccccggtcaaggttgatgtgctctaacagggcaaaaacagctgcgatcgttatccgcaaagcaactacgcaaagcctagtagcattttttgagagtatgtggttggtcgctccactataaacccaatagtagacctggcagatgaggctagaaattccccactggtaacagtgttctagcctgcgtggctgcctgcgtgctccttgtgagcacgaagccatatatttgacaaggtgtgaagagccccgtgtgcttgctttgagtcctccggcccctgaatgtggctaaccttaaccctgcagctagcgtgtacaatccagtacaaagctagtcgtaatgagcaattgcgggatgggaccaactactttgggtgtccgtgtttcctgtttttcttttatatttgcttatggtgacaatatatatataacatatatattggcatc

SEQ ID NO: 728 - DNA, 622 bp, Human rhinovirus
  35, complete genome.1
ttaaaacagcggatgggttccctaccatccgacccactgggtgtagtactctggtactctgtacctttgtacgcctgtttatccactacccttttcctaaattttccacccgtgtaaccttagaagcaaacaaattgtacaatagggtgcatcacaaccagtgatgtacagtacaagcacttctgtttccccggagcggggtatagacggtcaccactgtcaaaagcccttaaccgttacccgccaaccaactacgtaacggctagtaacaccatgaatttgtcttgacgttcgatcaggtggtaaccccccactagtttggtcgatgaggctgagaactccccacgggtaaccgtgtctcagcctgcgtggcggccaacccagcttctgctgggacgccaattcattgacatggtgtgaagacctgcatgtgcttggttgtgattcctccggcccctgaatgcggctaaccctaaccccggagccacgcggcataatccaatgtcgtatgggtcgtaatgagtaattctgggatgggaccgactactttgggtgtccgtgtttcctgtttttccaaattattcttatggtcacagcatataaatagatatatactgtgatc

SEQ ID NO: 729 - DNA, 622 bp, Human rhinovirus
  48, complete genome.1
ttaaaacagcggatgggtatcccaccatccgacccactgggtgtagtactctggtactctgtacctttgtacgcctgtttctcctcaaccctcccctacccgttatatatctcagtaacttagaagatatcattaccgcacaatagggaccgttgtaaccagcaacggtcagtgcaagcacttctgtttccccggagcggagtatagacggccactgctgtcaaaagctcttaaccgttacccgccagttaactacacaacagctagtaacatcttgttgttcttagggcgttcgatcaggtgagtttaccccctcactagtctggtcgatgaggctgagaaatccccacgggtgaccgtgtctcagcctgcgtggcggccagcccagcttatgctgggacgccttaagtatgacatggtgtgaagactcgcgtgtgcttagctgtgagtcctccggcccctgaatgcggctaacctaaaccccggagccttgaggcacaatccagtgcccgcgaggtcgtaacgagaaattctgggacgggaccgactactttgggtgtccgtgtttccttttatctttttgatgttcttatggttacaatatataaagtatattgtaatc

SEQ ID NO: 730 - DNA, 622 bp, Human rhinovirus
  68, strain ATCC VR-1178, complete genome.1
ttaaaactgggtccaggttgttcccacctggatctcctacgtggagttgtactctattattccggtaattttgtacgccagttttatctcccctacccctctatgtaacttagaagtttatgcacagcggccaataggtgacatttatccaaaatgtcaaaggtcaagcacttctgttaccccggttagaattgatatgctccaacagggcaaaaacaattttgatcgttatccgcaaggcaactacgcaaagcctagtaccatttttgatgatgtgtggttggtcgctccactgtgaacccgacagtagacctggcagatgaggctagaaattccccactggtaacagtgttctagcctgcgtggctgcctgcgtacccttttgcgggtacgaagccatacatttgacaaggtgtgaagagccccgtgtgcttgccttgagtcctccggcccctgaatgtggctaaccttaaccctgcagctagtgtgcacaatccagtgcatggctagtcgtaacgagcaattgcgggatgggaccaactactttgggtgtccgtgtttcttgtttttcttttatatttgcttatggtgacaatatatacataatatatatattggcacc

SEQ ID NO: 731 - DNA, 622 bp, Human rhinovirus
  78, complete genome.1
ttcaaactgaatcatggttgttcccaccatgattacctacgggtgtagtacacttgtatcccggtacatttgtgcgccagttttatatcccctaccccaattgtaacttagaagttaagcaacacaagatcaataggcggtggttatccaaaccatcaatgatcaagtacttctgtctccccggtaggtgtgaatatgctttaaccaaggcagaagctaatcctatcgttatccgcaaggtgcctacgggaagcctattaacactttgaaagaaatttggctggtcgctcagttgcgcaatcccacgcaatagacctggcagatggggctagacaaaccccaccagcgatggtggtctagcccgcgtggctgcctgcacacccttttttgggtgtgaagccagaaattggacagggtgcgaagagcctactgtgctcaccttgagtcctccggcccctgaatgtggctaatcctaaccctgcagctgttgcacaagatccattgtgtatacagtcgtaatgagcaattgcgggatggaaccaactactttgggtgtccgtgtttccttgttttcttttatcattgcttatggtgacaagtatatatagatatatttgtcatc

SEQ ID NO: 732 - DNA, 623 bp, Duck hepatitis A virus 1
  isolate HB02, complete genome.1
tttgaaagcgggtgcatgcatggccattttccagcacaggttcagctggtatggcatgcatgcatcgactgcttgggggtgtccctgacccccttaattcaacgtctagcccacgatacgggcaccctatccaatttgtatccctttacctcccatggactgacttgtatggacttggatctaaattggattatcctttacttgtggtggttagccaaccatgctctggtgtaatgattccatgtgttcatttggctaagtgccgaccttggaggtgggggtgaaattttgcaagccactagcgtcgtcaactttagcctctggagatgttggattagttgcattctggacagaccaagcctcgtctataccgtgggctaatggtcttcgttgtgaagcggattaccggtagtagcatcttagacttccaaggttgtcatgagtgtgtctgtagagtaggcacacatctgtccaggcacaagcacatctctcgatcgctccagactagttcctgagggacagatgttgtggggggcttgggaaaacccccttaacctacactaccggatagggtcgcggctggtcgagtcccacacactataatatcactagactttcatgca

SEQ ID NO: 733 - DNA, 623 bp, Human rhinovirus B102
  strain HRV-B92_p1044_sR122_2007 polyprotein1
aaaacagcggatgggtatcccaccatccgacccactgggtgtagtactctggtactttgtacctttgtacgcctgttcttcccattgtaccctcccttaacttccaacccaagcaacattagaagttatcaattttcagtacaataggaagcatcacatccagtgatgttgtgtacaagcacttctgtctccccggagcgaggtataagcagtacccactgctaaaagcctttaaccgttacccgccaatcaactacgtaacagctagtatcatcatgtttttgactggacgttcgatcaggtggttcccccccactagtttggtcgatgaggctaggaataccccacgggtaaccgtgtcctagcctgcgtggcggccaacccagcatttgctgggacgcccttttaaagacatggtgtgaagactcgcatgtgcttgattgtgattcctccggcccctgaatgcggctaaccttaaccccggagccttgtgttgcaatccagcaaaagcaaggtcgtaatgagcaattctgggacgggaccgactactttgggtgtccgtgtttctcattttacattacttttcttatggtcacagcatatataataaatatactgtgatc

SEQ ID NO: 734 - DNA, 623 bp, Human rhinovirus
  65, strain ATCC VR-1175, complete genome.1
ttaaaactgggtgtgggttgcacccacccacactgtctacggacgtagtgctctcatattacggtatgcttgcacgccagtttgtttcccctttccccttttgtaactatagaagattgcacttaatctcgaccaataggcagtagtgatccacactacttacggtcaagcacttctgttaccccggtatgcggagaataggctctgaaaagggctgaagcttcaattatcgtcatccgcgcaattactacgcaaagcttagtaacttcccaagaaattctttggttggccgttccgctggtaccccaccagtaggcttggcagatgaggctgagtaatccccactggcgacagtgactcagcctgcgtggctgcctacacacctggtaacaggtgtgaagccatagaaaggacagggtgtgaagagccccgtgtgctaattgtgattcctccggcccctgaatgcggctaatctaaccccacatccaatgcgcataagccaatgcgtatttggtcgtaatgggcaactgtgggacggaaccgactactttgggtgtccgtgtttctttttattccttataattagttcatggtgacaagtataagtgtttatatttgtcatc

SEQ ID NO: 735 - DNA, 624 bp, Picornaviridae sp.
  isolate wftcra73pic2 genomic sequence.1
ttttcatgttgtataattcgagttctccaattatatttaatagaagattttcatttatgatcatgcaataatataatgaattcatgtagaaaatgttatattattccttcgtcctttgtgaaccggagagttagtattggaaatgagggatttattttaaaacaaatgtcttatttcctctctttaacgttatatttattgacagtttgtgatttatatatcatggttattgagagaaaattagcttttatataaattagtgtttttatttaaaagttttaattcttggcagtgtattaatgaatttaatttggcagtataagtttattcaaaacataccttccatatgtagtagggaacttgctgtatttaatacaatactgattattaagtgtttttcttgtcgtataataattgaagtagaatcttttgttattccgactatagacttgattaataactgataatctttattttattttgtatagtattattaggttctagggaagtttccccctatgagaacctcctaaccttttggcaattaggcgaactaagaaaattgcctggacaatgggaagacccatataatattcccttttcctttataaatttaaatcaagt

SEQ ID NO: 736 - DNA, 624 bp, Salivirus A
  strain SH1 polyprotein gene, complete cds.1
ttcccctgcaaccattacgcttactcgcatgtgcattgagtggtgcatgtgttgaacaaacagctacactcacatgggggcgggttttcccgccctacggcttctcgcgaggcccacccctcccctttctcccataactacagtgctttggtaggtaagcatcctgatcccccgcggaagctgctcacgtggcaactgtggggacccagacaggttatcaaaggcacccggtctttccgccttcaggagtatccctgctagcgaattctagtagggctctgcttggtgccaacctcccccaaatgcgcgctgcgggagtgctcttccccaactcaccctagtatcctctcatgtgtgtgcttggtcagcatatctgagacgatgttccgctgtcccagaccagtccagtaatggacgggccagtgtgcgtagtcgtcttccggcttgtccggcgcatgtttggtgaaccggtggggtaaggttggtgtgcccaacgcccgtactcaggggatacctcaaggcacccaggaatgccagggaggtaccccgcttcacagcgggatctgaccctggggtaaatgtctgcggggggtcttcttggcccacttctcagtacttttcagg

SEQ ID NO: 737 - DNA, 624 bp, Human parechovirus 1
  isolate 146Chzj02, complete genome.1
tattagagttatggcacgccatctgccaccccacacaaatgtgggttagaaaagaaaactgtccctatgcctggtctccactattcgaaggcaacttgcaattagaagagtggaattaagacgcttaaagcatagagacagttttcttttctaacccacatttgtgtggggtggcagatggcgtgccataactctaatagtgagataccatgcttgtggaccttatgctcacacagccatcctctagtaagtttgtgagacgtctggtgacgtgtgggaacttattggaaacaacgttttgctgcaaagcatcctactgccagcggaaaaacacctggtaacaggtgcctctggggccaaaagccaaggtttaacagaccctttaggattggttctaaacctgagatgttgtggaagatatttagtacctgctgatctggtagttatgcaaacactagttgtaaggcccacgaaggatgcccagaaggtacctgtaggtaacaagtgacactatggatctgatttggggccagatacctctatcttggtgatctggttaaaaaacgtctagtgggccaaacccgggggggacccccggtttcctcttatcctattaatgccact

SEQ ID NO: 738 - DNA, 624 bp, Human rhinovirus
  79, strain ATCC VR-1189, complete genome.1
ttaaaacagcggacgggtatcccaccatccggctcactgagcgtagtactctggtattgtgtacctttgtacgcctgttttccccaaatcccctaccctttatatctcctaccccgtaacgtaagaagttttcaaacagtacaataggaagcaccacatccagtggtgttatgtacaagcacttctgtttccccggagcgaggtataggtggtcaccaccgccaaaagcctttaaccgttacccgccaaccaactacgtaatggctagtaacatcattgatttagattggcgttcgatcaggtggtatccccccactagtttggtcgatgaggctaggaataccccacgggtgaccgtgtcctagcctgcgtggcggccaacccagcatacgctgggacgccagtttactgacatggtgcgaagacttgcatgtgcttggttgagagtcctccggcccctgaatgcggctaaccttaaccccggagcctcgcagcataatccaatgttgtagaggtcgtaacgagtaattctgggatgggaccgactactttgggtgtccgtgtttcctgtttttctttaaaatgtcttatggtcacagcatatatactgtatatactgtgatc

SEQ ID NO: 739 - DNA, 624 bp, Human rhinovirus
  B86, strain SC9826, complete genome.1
acagcggatggataccccaccatccgacccactgggtgtagtacactggtactctgtacctttgtacgcctgtttctccccttgcaccctccctcattatcctaacccttgtaacattagaagatgagcaacccgtgcaataggagataccacaaccagtggtgttaagcacaagtacttctgtttccccggagcggagtatagacggtccccactgtcaaaagctcttaaccgttatccgccaaccaactacgtgacgactagtagcatcattttgacactttgacgttcgatcaggtaggttcaccccacctactagtttggtcgatgaggctgggagtccctcacaggtaactgtgtcccagcctgcgtggcggccaacccagcaattgctgggacgccaatttgttgacatggtgtgaagatcctaatgtgcttggttgtgagtcctccggcccctgaatgcggctaaccttaaccccggagccttgtggcacaagccagtgacattaaggtcgtaaggagcaattctgggatgggaccgactactttgggtgtccgtgtttcctatttttctttaaattgtcttatggtcacagcatatattaattatatactgtgatc

SEQ ID NO: 740 - DNA, 625 bp, Sapelovirus A
  strain NGR_2017_NHP_SV, complete genome.1
ccccatttctccccttcggcttcgtgccgtcgcacccctttacccttttccttaccctcttaagaatgattgtagattgttttagaaaggaaggttagtacacctgaaagtacaacaatttgcttctctggtttggataaaaggttaaagacattagaaggttaacacaggtccttgcaaaacctgagtacaattttgttttgacgacgagactggattatgatttcacggttggtcgccgaggttaaaagactattgtgctagctagagtaagtggttggcaattgaaagctaccaaaggggtgtaggtctacgctttgcgggctgaagctaccaatggattaatagtgagtatgttgtttttcccttctagtgatgcgcgaccgcacacaaaagagctaggggcacataggggcaaaaggaaaagtattacttatcctgaatgtgcaattgagtcggtgacgagtgcgtcagatgtgaatccagcatactggcgtatggcgcatcctcttggcattaccctaatgtgtatcttggtagggggggccctatcaacttagcctagtgctgcctgacagggttgcggctggtcatttgtgtgtggtataaccagtagtaatccctc

SEQ ID NO: 741 - DNA, 625 bp, Human rhinovirus 4
  complete genome.1
ttaaaacagcggatgggtttcccaccatccgacccactgggtgtagtgctctggtattttgtacctttgcacgcctgtttcccatttgtacccttccttaatctccttcccccgtaacgttagaagttttggaattttaaagtacaataggaagcgccacatccagtggtgttgcgtacaaatacttctgtttacccggagcgaggtataggttgtacccacggccaaaagcctttaaccgttatccgccaatcaactacgtaacggctagtatcatcttgcttttgatttggtgttcgatcaggtggtatcccccactagtctggtcgatgaggctaggaattccccacgggcgaccgtgtcctagcctgcgtggcggccagcccagcttttgctgggacgccttttcaaagacatggtgtgaagacctgcatgtgcttggttgtgagtcctccggcccctgaatgcggctaaccttaaccctggagcccagcagcataatccaatgttgtttgggtcgtaatgagcaattccgggacgggaccgactactttgggtgtccgtgtttccttttattcttacattgtcttatggtcacagcatatatattatatatactgtgatc

SEQ ID NO: 742 - DNA, 625 bp, Human rhinovirus
  99, strain ATCC VR-1299, complete genome.1
ttaaaacagcgggtgggtatcccaccacccgacccactgggtgtagtacactggtattttgtacctttgtatgcctgtttgccatccctccctctcctcttacccttacccttattttgcggtaactttagaagtttgtaaatcacgcgcaatagggtataccacatccagtggtatgaagcacaagcaattcttgttccccggagctggatataaactgctaacgtggttgaaagtccttaaccgttatccgccagttaactgcgagaagactagtaactccatgtttgtttttaagcgttcgatcaggtggataccccattcactagtttggtcgatgaggctgggaatcccccacaggtaactgtgtctcagcctgcgtggcggccaacccagcttttgctgggacgcttactgacagacatggtgtgaagatcctattgcgcttaactgtgagtcctccggcccctgaatgcggctaacctcaaccccggagccttgtggtgtaaaccaacactcgcaaggtcgtaacgagtaattctgggacgggaccgactactttgggtgtccgtgtttcctttatttcttattgattgtctcctatggttacaaatttactgtaatc

SEQ ID NO: 743 - DNA, 625 bp, Human rhinovirus
  97, strain ATCC VR-1297, complete genome.1
ttaaaacagcggatgggtttcccaccatccgacccactgggtgtagtgctctggtattttgtacctttgcacgcctgtttcccctttgtacccatcctgaatttcctccctctgcaacgttagaagtttgtgaaattaaaagtacaataggaagcatcacatccagtggtgttcagtacaagcactcctgtttccccggagcgaggtataggttgtacccacgaccgaaagcctttaaccgttatccgccaatcaactacataacggctagtatcatcatgtttttgatctggcgttcgatcaggtggtttcccccactagtctggtcgatgaggctaggatttccccacgggcgaccgtgtcctagcctgcgtggcggccagcccagcttatgctgggacgcctttttaaagacatggtgtgaagacctgcatgtgcttgattgtgagtcctccggcccctgaatgcggctaaccttaaccctggagcccgacagcataatccaatgttgtttgggtcgtaatgagcaattccgggatgggaccgactactttgggtgtccgtgtttctttttattcttatattgtcttatggtcacagcatatatagtatatatactgtgatc

SEQ ID NO: 744 - DNA, 625 bp, Human rhinovirus
  71, strain ATCC VR-1181, complete genome.1
ttaaaactgagtgtgggttgttcccacccacactgtctacggacgtagtgctctcatattccggtatgtttgcacgccagtttgcctctccttttcccacgtaacgttagaagcttatgcactaaatcgaccactaggtgagtgataaaccatatcattctttggtcaagcacttctgtttccccggtatgcagggaataggccctccccagggctgaagccttaattatcgttatccgcacatttactacgcaaagcctattagcgttctggaagttcactggctggtcgttccgctagactaacccgtctagtagacctggcagatgaggctggataaaccccactggcgacagtgatccagcctgcgtggctgcctgcacacctggaaacaggtgtgaagcccatgaatggacagggtgtgaagagccccgtgtgctaagtgtgagtcctccggcccctgaatgcggctaatctaaccccacagctaatacacacaaaccagtgtggatttagtcgtaatgggtaactgtgggacggaaccgactactttgggtgtccgtgtttccttttattccttttatattgcttatggtgacaggtatatagatatatatttgttacc

SEQ ID NO: 745 - DNA, 625 bp, Human rhinovirus
  type 16 polyprotein gene, complete CDS.1
ttaaaactggatctgggttgttcccacccagatcacctacatggtgttgtacactattattacggtaatcttgtacgccagttttatactccctttcccaaatgtaacttagaagcaaagcaaactgatcaataggggacaatcatccagattgtcaaagatcaagcacttctgtttccccggtcaaagttgatatgctccacaagggcaaaaacaactgagatcgttatccgcaagatgcctacgcaaagcctagtaatacattgaaagatacttggttggtcgctcagctgttaacccaacagtagacctggtagatgaggctagagattcccctccggcgacggagttctagcctgcgtggctgcctgcacacccactgggtgtgaagccaagtattggacaaggtgtgaagagccgcgtgtgctcatcttgagtcctccggcccctgaatgtggctaaccttaaacctgcagccagtgcacacaatccagtgtgtagctggtcgtaatgagcaattgcgggatgggaccaactactttgggtgtccgtgtccgtgtttcactttttttccttttattattgcttatggtgacaatatatatagcatatatatattgttatc

SEQ ID NO: 746 - DNA, 625 bp, Rhinovirus C
  isolate 2536, complete genome.1
ttaaaactgggtaggggttgttcccacccctaccacccacgtggtgtagtgctcctgtattacggtacacttgcacgccagtttgcctccctacccccttcccattcacacccaaccctgcgtaacttagaagctatgcacaagaccaataggtggtaacaatccatgttactaaaggtcaagtacttctgtttccccggcatgcgtggaataaacagtgcaaacggttgaggccacaaatgtcgttacccgcgcatgaactacgcagagcctagtatccccctgaaagtccattggttggtcgctcagctaatccccatagtagacctggcagatgaggcaagacgcaccccactggcgacagtggtcttgcctgcgtggctgcctgcacacccttcggggtgtgaagccaattgatagacagggtgtgaagagccgagtgtgcttcatgtgagtcctccggcccctgaatgcggctaatccaaccccgcagctgtggcacacaatccagtgtgtatgcagtcgtaacgggcaactgcgggacggaaccgactactttgggtgtccgtgtttccttttattctttaatcaagtacttatggtgacaataataaatattgttacc

SEQ ID NO: 747 - DNA, 626 bp, Human rhinovirus
  83, strain ATCC VR-1193, complete genome.1
ttaaaacagcggatgggtatcccaccatccgacccactgggtgtagtactctggtattttgtacctttgtacgcctgtttcttccctttgtacccgccccttaaacttccaccccacgtaacgttagaagtttatacaagcagtacaataggttgcaccataaccagtggtgtttcgtacaagcacttctgtttccccggagcggggtatagacggtacccactgtcaaaagcccttaaccgttatccgccaatcaactacgtaatggctagtaacaccatgaaggtaagttgacgttcgatcaggtggtaacccccactagtttggtcgatgaggctaggaattccccacgggtaaccgtgtcctagcctgcgtggcggccaacccagcatttgctgggacgccaatttactgacatggtgtgaagacttgcatgtgcttgattgtgactcctccggcccctgaatgcggctaaccttaaccccggagccttgcagcataatccaatgttgtggaggtcgtaatgagcaattctgggatgggaccgactactttgggtgtccgtgtttcctgttttctttaagttgtcttatggtcacagcatatatactatatatactgtgatc

SEQ ID NO: 748 - DNA, 626 bp, Human rhinovirus
  3, complete genome.1
ttaaaacagcggatgggtaccccaccatccgacccactgggtgtagtactctggtacttcgtacctttgtacgcctgttcttcccattgtacccttcctgaacttccaacccaagtaacgttagaagctcaacatttagtacaacaggaagcaccacatccagtggtgtttagtacaagcacttctgtttccccggagcgaggtataggctgtacccactgccaaaaacctttaaccgttatccgccaaccaactacgtaaaagctagtagtattatgtttttaactaggcgttcgatcaggtggatttcccctccactagtttggtcgatgaggctaggaattccccacgggtgaccgtgtcctagcctgcgtggcggccaacccagcttatgctgggacgcctttttatagacatggtgtgaagactcgcatgtgcttggttgtgattcctccggcccctgaatgcggctaaccttaaccctggagccttgtgtcacaaaccagtgatgataaggtcgtaatgagcaattccgggacgggaccgactactttgggtgtccgtgtttcttatttttcttattattgtcttatggtcacagcatatatataacatatactgtgatc

SEQ ID NO: 749 - DNA, 626 bp, Rhinovirus C
  strain 20692_6_HRV-C polyprotein gene, complete cds.1
aacagccgtctggttgatcccaccagcgggcacaatgtgcgttgtacactgcgatctcggtcgctttgtatgcctgtttttaccacccaccccaactttactatcttctttacttcacaagtaacatagaagcatgtacatgacgcccaataggacaacgtctcacccagagatgttaagggcaagcacttctgtttccccggatgtgtgaataggcttcacccgaggctgaaactgtagcattcgttatccgcatgactactacgcgactgctagtagcgttctgtgtgacatgtggggtttcgttcagcagagacccagtctgtagatcagggtaatgaggctacacaatccccactggtgacagtggtgtagcctgcgtggtgccctgcccgaggttcgtcctcgggaccctccatgttagacagggtgtgaagacactagtgtgctagtcatgagtcctccggcccctgaatgcggctaatcttaaacctgcagccaccacatgcacgccagcatgcaggtggtcgtaatgagcaattgcgggatggaaccgactactttgggtgtccgtgtttctctttttacatttatgtgtctcttatggttacatcattggtgtaatc

SEQ ID NO: 750 - DNA, 627 bp, Picornaviridae sp.
  isolate zftegr01hep2nc genomic sequence.1
ttcaaggttcagccggccgggggttttgaggggttttggctggtccctatggaggcatagttatcgggactgtattcccgatggtttgagttagggccgacctgctcctgtattgcccacagctttgggctatcttgaggtgtttgtttgtgggaccctctcttgggtctcatttgtttttcttctgttttatgtctatcttttcccggttgtctccatacctatgctgctaccgctgcgcccggcggggttaaccctggggctagcccatggctgtggccgccaaaagtggagatgtcatgactattccatggcttgggctttgggtgtgtccagcaggtgacaggaacttagctgatcttggcaggggggtaggctacgggtgaaacccccccgtcctctcactcatattgagtgatgtcgtgtacacgtgaaccttggtggataggggtgagatcgtttggtcaaaaacccctcaacgcctggtgcgggcatgtcgtcatgtcatgcggctttgttcgtgtttcctgtctgttggcacccagtgctgaactcatggtaattggcaccctatgagtttagggctaatcaggggcatttaggtttttagcaccactgcttaatttg

SEQ ID NO: 751 - DNA, 627 bp, Human rhinovirus
  92, strain ATCC VR-1293, complete genome.1
ttaaaacagcggatgggtatcccaccatccggcccactgggtgtagtactctggtacattgtacctttgtacgcctgttttccccctcttgtacccgcccttcaagctccttgcccaagtaacgttagaagtttgaacattggtacaataggaagcatcacatccagtggtgtactgtacaaacacttctgttgccccggagcgaggtatagatggtccccaccgtcaaaagcctttaaccgttatccgccaatcaactacgtaatggctagtagcaccttggatttaagttggcgttcgatcaggtggtaacccccactagtttggtcgatgaggctaggaattccccacgggtgaccgtgtcctagcctgcgtggcggccaacccagcatccgctgggacgccaatttaatgacatggtgtgaagacctgcatgtgcttgattgtgagtcctccggcccctgaatgcggctaaccctaaccccggagccttgcagcacaatccagtgttgttaaggtcgtaatgagcaattctgggatgggaccgactactttgggtgtccgtgtttcttatttttcttgaatttttcttatggtcacagcatatatacattatatactgtgatc

SEQ ID NO: 752 - DNA, 627 bp, Human rhinovirus
  27, complete genome.1
ttaaaacagcggatgggtatcccaccatccgacccacagggtgtagtgctctggtattttgtacctttgcacgcctgtttccccattgtacccctccttaaatttcctccccaagtaacgttagaagtttaaggaaacaaatgtacaataggaagcatcacatccagtggtgttatgtacaagcacttctgtttccccggagcgaggtataagtggtacccaccgccgaaagcctttaaccgttatccgccaatcaactacgtaatggctagtattaccatgtttgtgacttggtgttcgatcaggtggttccccccactagtttggtcgatgaggctaggaactccccacgggtgaccgtgtcctagcctgcgtggcggccaacccagcttttgctgggacgcctttttacagacatggtgtgaagacctgcatgtgcttgattgtgagtcctccggcccctgaatgcggctaaccttaaccccggagccttgcaacataatccaatgttgttgaggtcgtaatgagtaattctgggatgggaccgactactttgggtgtccgtgtttccttttattctttatattgtcttatggtcacagcatatatagcatatatactgtgatc

SEQ ID NO: 753 - DNA, 628 bp, Human rhinovirus
  93, complete genome.1
ttaaaacagtggatgggtttcctaccatccgacccactgggtgtagtgctctggtatattgtacctttgcacgcctgttttcccattgtacccttccttaaattcctccccatgtaacgttagaagtttaagaacataaatgtacaataggaagcatcacatccagtggtgtatggtacaagcacttctgtttatccggagcgaggtataagcggtacccactgctgaaagcctttaaccgttaaccgccaatcaactacgtaacggctagtattaccttgtttgcaatctggcgttcgatcaggtggttccccccactagtttggtcgatgaggctaggagttccccacgggcgaccgtgtcctagcctgcgtggcggccaacccagcatttgctgggacgcctttttgtagacatggtgtgaagacctgcatgtgcttgattgtgagtcctccggcccctgaatgcggctaaccttaaccccggagccttgtgacataatccaatgtcattaaggtcgtaatgagcaattctgggacgggaccgactactttgggtgtccgtgtttctctttattctttacattgtcttatggtcacagcatatataatacatatatactgtgatc

SEQ ID NO: 754 - DNA, 628 bp, Human rhinovirus
  type 14 (HRV14), complete genome.1
ttaaaacagcggatgggtatcccaccattcgacccattgggtgtagtactctggtactatgtacctttgtacgcctgtttctccccaaccacccttccttaaaattcccacccatgaaacgttagaagcttgacattaaagtacaataggtggcgccatatccaatggtgtctatgtacaagcacttctgtttcccaggagcgaggtataggctgtacccactgccaaaagcctttaaccgttatccgccaaccaactacgtaacagttagtaccatcttgttcttgactggacgttcgatcaggtggattttccctccactagtttggtcgatgaggctaggaattccccacgggtgaccgtgtcctagcctgcgtggcggccaacccagcttatgctgggacgcccttttaaggacatggtgtgaagactcgcatgtgcttggttgtgagtcctccggcccctgaatgcggctaaccttaaccctagagccttatgccacgatccagtggttgtaaggtcgtaatgagcaattccgggacgggaccgactactttgggtgtccgtgtttctcatttttcttcatattgtcttatggtcacagcatatatatacatatactgtgatc

SEQ ID NO: 755 - DNA, 630 bp, Human rhinovirus
  72, strain ATCC VR-1182, complete genome.1
ttaaaacagcggatgggttctcccaccatccgacccactgggtgtagtactctggtatgatgtacctttgtacgcctgtttattcccaaacccccacccgttattcgcccaacccctgtaacgttagaagtttggaacttaattgtacaatagggagcaccatatccaatggtgtaacgtacaagcacttctgtttccccggagcgaggtataggtggtacccactgccgaaagcctttaaccgtcatccgccaatcaactacgtaacagctagtaacatcttgttgttgattggacgttcgatcaggtggttcaccccccactagtttggtcgatgaggctgggaatcccccacgggtgaccgtgtcccagcctgcgtggcggccaacccagcttatgctgggacgccctttcaatgacatggtgtgaagactcgcatgtgcttgattgtgagtccgccggcccctgaatgcggctaaccctaaccctggagccttgcaccacaatccagtggtgtctgggtcgtaatgagtaattctgggatgggaccgactactttgggtgtccgtgtttctcatttttcttttaattgtcttatggtcacagcatatagtattatatactgtgatc

SEQ ID NO: 756 - DNA, 631 bp, Human rhinovirus
  5, strain ATCC VR-485, complete genome.1
ttaaaacagcgggtgggtatcccaccacccgacccactgggtgtggtacactggtactttgtacctttgtatgcctgtttgcttccactcccctttacctaatattcttccccaagtatattttgcggtaacgttagaagaagcaaagttagtgcaataggatgtatcacaaccagtggtataaagcacaagcaattcttgttccccggagctggatatagactgctaacgtggtcaaaagtccttaaccgttatccgccagctaactgcgagaagactagtaacaccatgtttgtttttagacgttcgatcaggtgaataccccattcactagtttggtcgatgaggctgagaataccccacaggtaactgtgtctcagcctgcgtggcggccaacccgactcatgtcgggacgcctactaatagacatggtgtgaagatcctattgcgcttagttgtgagtcctccggcccctgaatgcggctaaccctaaccccggagccttgtggtgtaaaccaacatttgcaaggtcgtaatgagtaattctgggatgggaccgactactttgggtgtccgtgtttcctttatttttattgtgtgtgtcttatggttacaaatacaatttgtaatc

SEQ ID NO: 757 - DNA, 632 bp, Duck picornavirus
  duck/FC22/China/2017, complete genome.1
ttgaaaactggcccccctggggatctttgcacctttgaagtgcatatcctcaggggttaaccaggtggtggacataatgtccacctttgtttcaacatggttctttggcattttctccagagtaactaaaagataaatgccatctggatggattttctggttataaaatgactttctcgttgatcggtttttccactatcttcattgccgggtggttgccaagcccggaagtgctatcactctaggattcgagtcttcatccgtcgcggatttctagggcccatatctggtgctgaaatattgcaaggaatggtgaaccctagttgtctaacactgtaagtctcgatgtcttagaccaggtagccttggcacaattcctaaccaccaacatgtttctcgtgaaattccctcgccggggtgtagtagcgagtctcctctgttgggctcatggttaggggatgctcctaggtagagtggaacctcttcttcattttaaggtgggacctgattcagtatcccactggaagttagaggtctgggtattggggtaacccagcttggtccacactgcttgatagagtcgcggctggccgacctaggacatctttaaaaagtcagttgattttaacctt

SEQ ID NO: 758 - DNA, 633 bp, Pink-eared duck megrivirus
  polyprotein gene, complete cds.1
gggggctcttccccctgggctcttttccggtaatccgattggcgaccggattatcgtgactctgctgagtcgtccgtgcctctaggaaacttgttggctccggctgacactttttctggacatcggatgggcggcttggtggggctagccaaccctgactgactttatgtgtatgacctcttttcctcttgcgctttagtctgtcgcgtctgatccacgtacggattaaatggtatgtcataaggctaagcctcgttctgaaatcccctagccaaaggggcctagtaggatcttggtgtttccttatgacctctaccgaccatgttagctagagctagggctgaataggatgcatcccagactcctttttggatatctggagcaagacaccggagtttaactatgtacgctggataaggctcgaacacacccagattgaaggtggtgctgaaatattgcaagcctaggtctgtgtagtgttagtagatgcccgccgctatagttttctccgccccctgtgggttagtagtgtacctatttggacgcagagccggcaatctctgcctttgcctagtactggttgatagacccgcggctggtcgagttaacatggtataaccagttgaaacggct

SEQ ID NO: 759 - DNA, 633 bp, Swine vesicular disease virus
  strain SVDV Itl. 2-97 polyprotein1
cacccacagggcccactgggcgctagtacactggtatcacggtacctttgtgcgcctgtttgacccaccttccccaaacgtaacttagaagcacaactcaaatgatcattagacggctcagtatgccaactgggtctcgatcaagcacttctgttaccccggactgagtaccaataggctgctcacgcggctgaaggggaaaccgttcgttacccgaccaactacttcgagaaacctagtaccaccatgaaagttgcgcagcgtttcgctccgcacaaccccagtgtagatcaggccgatgagtcaccgcaaaccccacgggcgaccgtggcggtggctgcgctggcggcctgcccatgggacaactcatgggacgctacaatactgacatggtgtgaagagtctattgagctagttggtagtcctccggcccctgaatgcggctaatcctaactgtggagcagatacccacgcaccagtgggcagtctgtcgtaatgggcaactccgcagcggaaccgactactttgggtgtccgtgtttcttttattcctacgctggctacatatggtgacgatttgtaccataaagccttaaccgctcctcaacaccgtcataacacttaacacgctgag

SEQ ID NO: 760 - DNA, 633 bp, Human rhinovirus
  1B, strain 12J7, complete genome.1
ttaaaactgggtgtgggttgttcccactcacaccacccaatgggtgttgtactctgttattccggtaactttgtacgccagttttccctcccttctccccctcctacccttttacgtaacttagaagctttaaacatgagaccaatagcaggcaactttccaggttgtctaaggtcaagcacttctgtttccccggttgacgttgatatgctccaacagggcaaaaacaactgatatcgttatccgcaaagtgcctacacagagcctagtaggattctgaaagatctttggttggtcgctcagctgcatacccagcagtagacctcgcagatgaggctggacattccccactggtaacagtggtccagcctgcgtggctgcctgcacacctcttacgaggtgtgaagccaaggattcgacagggtgtgaagagccgcgtgtgctcactttgagtcctccggcccctgaatgcggctaaccttaaacctgcagccatagctcataagccaatgagtttatggtcgtaatgagtaattgcgggatgggaccgactactttgggtgtccgtgtttcattttttccttttatcaattgcttatggtgacaatatatatatatatatatattggcatc

SEQ ID NO: 761 - DNA, 634 bp, Ljungan virus
  M1146 polyprotein gene, complete cds.1
agaatagccaatctgtaacttcaacacctaagcgcatcttgcccgccgttatctggtcgaaggcacttgcaataagactggttaaccctccatgcgtgattcacaatcctatctgtctctcgagtgctttacgctcgggtaggggctcacccaggaggtcccactctttacagaggtctgcgcaggtggctttcacctctcgacagcgcccctcaatcctgccttaggtgtgaaggttgcacgtattccaatgtgaacagtgcttgaattttgttggtaggtgtagcgaccacacatgagccagcggatttcccctggtggtaacaccagcctctgggcccaaaaggcatgtctttgacctcatgtgtgcacaatcccagtgatgccaatgattagtaaagcacttagtatatatatgggatataccaatctcaagcacctaagggtgtaggtatggtaggctgaaggatgccctggaggtacccgcaggtaacgattggttcactgtggatctgaccaggggcccaccggaacttcgttctgggtagaagctctcgagccttgggttaaaaaacgtctaggcctatcccccggggggacccggggtttcccttataaccccatattttgcatc

SEQ ID NO: 762 - DNA, 636 bp, Bovine viral dirrhea virus
  nonstructural proteins (p125/p80, p10,1
tggagtctatacgaggaggacagcctgttaataacccagttagaaatatcaaataatttactcatatcagaagacttgccagccgctgtcaagaacataatggccaggactgatcacccagagccgatccaacttgcttacaacagttatgaggtccaggtcccagtcctgttcccaaaaataaggaacggagaggttacagacacctacgaaaactactcatttctaaacgctaggaagttaggagaggatgtgcccgtatacatctatgccactgaagatgaggacctggcagttgacctcctagggctggactggcccgaccctgggaatcagcaggtcgtggagaccagcaaagcactgaagcaagtggccggattgtcttcagctgagaatgccttgctcatagctttatttgggtatgtaggttaccaagctctatcaaagaggcatgtcccaatggtcacagatatatacactatagaggaccagagactggaagacaccacccacctccagtatgcacccaacgccataaaaaccgaagggacagagactgaattgaaggaattgccggcgggtgacgtggagaaaatcatgggagccatctcggattatgcagctggaggactggaa

SEQ ID NO: 763 - DNA, 637 bp, Unknown
  Description of Unknown: Human coxsackievirus A16, strain shzh01-17 polyprotein gene, partial1 sequence
acttagaagcttcacacaatcacgaccatcagtaggcctggcatcccagtcacgtcttggtcaagcacttctgttccccctgactgagtatcaataaactgctcacgcgggtgaaggagaaaacgttcgttatccggctaagtacttcgagaaccccagtagcaccgtgaaagttgcggagtgtttcgctcagcacttcccccgtgtacatcaggtcgatgagttactgttaaccccacgggcgaccgtgacagtggctgcgttggtagcctgcccatggggttacccttgggacgctctcatacagacctggtgtgaagagtctattgagctagttagtagtcctccggcccctgaatgcggctaatcctaactgcggagcacgcaccctcaacccagggggcggcgtgtcgtaacgggtaactctgcagcggaaccgactactttgggtgtccgtgtttccttttattccttactggctgcttatggtgacaattgaaaagttgttaccatatagctattggattggccatccggtgtctaacagagctattgtttacctatttattggatacgtccctcttaatctcaaggccattcaaactcttaattatatattgctccttaactgtaagaa

SEQ ID NO: 764 - DNA, 638 bp, Phopivirus
  strain NewEngland_USA/2011, complete genome.1
gggagtaaacctcaccaccgtttgccgtggtttacggctacctatttttggatgtaaatattaattcctgcaggttcaggtctcttgaattatgtccacgctagtggcactctcttacccataagtgacgccttagcggaacctttctacacttgatgtggttaggggttacattatttccctgggccttctttggccctttttcccctgcactatcattctttcttccgggctctcagcatgccaatgttccgaccggtgcgcccgccggggttaactccatggttagcatggagctgtaggccctaaaagtgctgacactggaactggactattgaagcatacactgttaactgaaacatgtaactccaatcgatcttctacaaggggtaggctacgggtgaaaccccttaggttaatactcatattgagagatacttctgataggttaaggttgctggataatggtgagtttaacgacaaaaaccattcaacagctgtgggccaacctcatcaggtagatgcttttggagccaagtgcgtaggggtgtgtgtggaaatgcttcagtggaaggtgccctcccgaaaggtcgtaggggtaatcaggggcagttaggtttccacaattacaatttgaa

SEQ ID NO: 765 - DNA, 639 bp, Chicken megrivirus
  strain chicken/B21-CHV/2012/HUN, complete1
ttcccgaccggtctggcaaaccggacggttatcctggttagatgtctgatggttgctggaacgtggtggctactgctgccaccttctggcttcctttaatgggcatctagctgggttctttgccacaatccatcttactctcttacccattttctattacccagacttgttgttaactggtaaagttgacctactggcttcgttttgagactattctggtgttggtggacactctttccacaagtagattgtatggagttcatgctcgttttgaaccgggaatggcacaacccgtagtaggatcttgcctctgccatactaatctgcgcctgttgcttttagactatgggctgctaaggatgacattggaacccctttttggatattccatgtcaagtcaactgtttcatctggtgtacgctggaaatccttgttccgaggtcttgtctggaggtggtgctgaaatattgcaagccacaggcagttccttggacttggtgccgctatcagatgctacaccctctatgggcaaatgttgaaccttagtggacgcgtgagatgggaatccacgccggccatagactggctgataagctcgcggctgatcgagttgcaacagtaatcagttgatttgccact

SEQ ID NO: 766 - DNA, 639 bp, Human rhinovirus C
  isolate N10, complete genome.1
ttaaaacagccgtgtggttgtacccaccaccgggcacattgtgcgtggtacactggaattacggttcctttgtacgcctgttttcccttcccactttctttcttccttcacttcctaattgtaacataattagaagcatgacatacagtccaataggaggcggttaatccataaccgtcatagacaagcacttctgtttccccggatgtgtgaataggcttccaccgaggctgaagctgtagcattcgttatccgcacacgtactacgcgaaaactagtaacaccttgattggtggtgtggtgtttcactcggcgctaccccagcgtagatcagggcaatggggctacggaaaccccaccggcgacggtgtcgtagcccgcgtggtgccctgcccagatccttgcgatctgggacaccatatcattgacagggtgtgaagattctagtgtgctacgtgtgagtcctccggcccctgaatgtggctaaccttaaccccgcagctatggtgtgcaaaccagcacattcgtagtcgtaatgggcaactgtgggatgggaccaactactttgggtgtccgtgtttccttttattcttataattttccttatggttacaagcttatggttataggtttgtaacc

SEQ ID NO: 767 - DNA, 639 bp, Rhinovirus C
  strain USA/WI/2014-20992 polyprotein gene, partial1
gacataagcgccgggtttgttaaaacagctgcgtggttgttcccaccaccaggcacacagtgcgtggtacactggaatttcggttcctttgtacgcctgttttcccaccctcatgtttgtttgtctttacgcgtaacttagaagcattgcaaacagctcaataggaatagtccatccaggactgttacgagcaagcacttctgtctccccggacgtgtgaatagacctcaccaaggttgaagctgtagcgttcgttatccgctcatctactgcgcaaagactagtaactaactgaagccttaatggtgtttcgctcagcagtaccccactgtagatcagggcaatgaggctacgcattccccactggtgacagtggcgtagcctgcgtggtgccctgcccaggtttcggcctgggacaccattttgacgacagggtgtgaagaccggcgtgcgctaggtgtgagtcctccggcccctgaatgcggctaatcctaaccctgcagccattgcatgtgatccaacatgtggatggtcgtaatgagtaattgcgggatggaaccgactactttgggtgtccgtgtttcctgttttaccaattactgtctcatggttacaaatttgtgtatcaagtttgtaact

SEQ ID NO: 768 - DNA, 640 bp, Pigeon mesivirus 2
  strain pigeon/GALII5-PiMeV/2011/HUN, complete1
ttttgaaaagggtcccagggggatcttttattccctctgggcccttttcacgtagtagggagtggcgcccctactgcgttactctgccaggtagtctgggtaggtaaacgggagatcggcttcgggcttatcttcttaatagcctacgtaactgggctgactggtgggggagctactagatccgggaaaggactagttaccccttgtaactctccttcgtgtcaccccatccacttaccctttttccctaccccttagaatcttaagtagatgtgcaggcctggccccccggaaatgggcaaatcggacgtttgcgtgtagggtcgttctgaaaggtggggcccactccaccgtagtaggatcttcctgtttcacgtttaaacctctccgggcaggtgtcgctagacactaggctgtataggatggcaagcacttaggtttcgcaccttcctagtgcgccaagaccccgtcttttagttttagtacatggttctttgtaagatgtctaaccagaggaggtggtgctgaaatattgcaagccactctggcgaacgtccgctgcattgcctggaacgaactttctgacgtctagcactggtagcgcggtactagattagtagggtacctatatggacagggg

SEQ ID NO: 769 - DNA, 640 bp, Rhinovirus C
  isolate 8097-MY-11, complete genome.1
ttaaaacagccgtgtggttgttcccaccaccggacacactgtgtgttgtgcactggaatctcggttcctttgcatgcctgttttataaccccttcccctttactttctatcattcttttcttccaagtaacttagaagctgaacaacagtccaataggaagtgaccaacccatggtcactaaggacaagcacttctgtttccccggatgcgtgaatagactctaaaagggttgaagctgtagcattcgttatccgcacttgtactacgcgatggctagtatcatcctgctctttccattggcgtttcgctcagcgtggtatcccccacgtagatcagggtaatgaggctacatgtaccccaccggcgacggtgatgtagcctgcgtagtgccccgcctgggtcttgtgcccaggacgccataggtcagacagggtgtgaagacttgagtgtgctacaagtgagtcctccggcccctgaatgcggctaatcctaaccccgcggctatcgtacgcaatccagcgtattggtagtcgtaatgagcaattgtgggatggaaccgactactttgggtgtccgtgtttcctttatttcttgacatgttgcttatggtcacaagtttatggttataaatttgtgatc

SEQ ID NO: 770 - DNA, 641 bp, Grey squirrel kobuvirus
  isolate UK 2010 polyprotein gene, complete1
ggatttaggccgtggtgcccgtgggcacgacggccacggctccagccgcactcctctccacgccttgtcccacgggacataaagtggagccctaagccctaaacccccatgttacccaattttcttatccacttccctttttccctttgactcacatttttcttgaccgcgcttgtgaggcggttcccgtacagttgagttgacgggtcccgcgcgggacctgaaaattactccatactgattaggaaaggttctagtacgcttgtacccttaaggccagcgggctacctcctttaggtcttatagccccaactggttagaaccactccagctcacctctatcggtgcgggagtgctaccacccctgcctgcgtcaagcccgtttttctagtgatctgtccacaaacacttggattcccgtcgcgactgacagaacctggcgacaggtgtctcgatgtgtgtgaccaagtggcatgagaatcggaaactaacgctggtaagatggtaagtgcccaatccctgtggggtgatgtttttctctgcataggaatgctgcgaaggtaccccggccttgagtcgggatctgatcgcaggctaattgtcctctgtgcagttcatttccttttcttttcattggcatc

SEQ ID NO: 771 - DNA, 641 bp, Human rhinovirus
  C51, isolate LZ508, complete genome.1
ttaaaacagccgtgtggttgtacccaccaccggacacactgtgtgttgtgcactggaatctcggttcctttgcatgcctgttttaaaccccccttcccccactctttctatcattcttttcttcctaatgtaacttagacgttataccacagtccaataggacgtggccaatccaggccatgacggacaagcacttctgtctccccgggcgtgtgaataggcctcaacaaggctgaagctgtagcgctcgttatccgcatttgtactacgcgatggctagtatcatccttctcttggtcttggcgtttcgctcagcgtggtaaccccccacgtagatcagggcaatgaggctgcatatgccccaccggcgacggtgatgcagcctgcgtggtgccccgcctgggttaacccccaggacgccacaatcaagacagggtgagaagacctgagtgtgctacagatgagtcctccggcccctgaatgcggctaatcctaaccctgcagctatcgtatgcaaaccagcatattggtagtcgtaacgagcaattgcgggacggaaccgactactttgggtgtccgtgtttctctttttatttgaaatgttgcttatggttacaagttttggtattaaacttgtgacc

SEQ ID NO: 772 - DNA, 641 bp, Rhinovirus C
  strain 20692_95_HRV-C polyprotein gene, complete cds.1
tgtgtacatctcttctagtttcggggaggggtttaaaactgaaccacggttgttcccactgtggttacctaaagggtgtagtggtcttgtattacggtacatttccatgccagttttatcacccctccccgaaattagaagagatgtacacaccgaccaatagggagtggccaaccaggtcgctaaaggtcaagcacttctgtttccccggttggtttggatatgctttacccaaggcaaaaaccgaaccagtcgttatccgcaaagtgcctacgagaagcctagtagcatcttcgaaaccaatggttggtcgctccattgcaaccccagcaatagacctggcagatgaggctgagcagtccccgccagcgatggtggctcagcctgcgcggctgcctgcgcaccccttagggtgcgaagccagaaagtggacaaggtgtgaagagcctattgtgctcactttgagtcctccggcccctgaatgtggctaatcttaaccccgcagctatcgcacataaaccaatgtgtaggtagtcgtaatgggcaactgtgggatggaaccaactactttgggtgtccgtgtttccttgttttctttacaaatgcttatggtgacaattgtgtgatatacagttgtcgcc

SEQ ID NO: 773 - DNA, 642 bp, Echovirus
  E3, strain 2-E6-TW, complete genome.1
taatgtaacgtagaagttttacacactgatcaacagtaggcacagcgcaccagttgtgtctcgatcaagcacttctgtctccccggaccgagtatcaatagactgctcacgcggttgaaggagaaagcgttcgttacccggctgactacttcgagaaacctagtagcactatgaaagttgcgaagtgtttcgttcagcacttcccccgtgtagatcaggtcgatgagtcactgtattccctacgggtgaccgtagcagtggctgcgttggcggcctgcccatggggcaacccatgggacgcttcaatacagacatggtgcgaagagtctattgagctagtcagtagtcctccggcccctgaatgcggctaatcctaactgcggagcatgtgccttcgatccagagggtagcatgtcgtaatgggcaactctgcagcggaaccgactactttgggtgtccgtgtttccttttattcttatactggctgcttatggtgacaattgagagattgttgccatatagctattggattggccatccggtgagtaatagagctattatctactcctttgtgggttttgtatcattgaactataaggtcttgaagactctcaactttattttgacactcaacaccgcaaa

SEQ ID NO: 774 - DNA, 643 bp, Echovirus
  E25, strain USA/CA/RGDS-2017-1010, complete genome.1
aagcgtaacttagaagcttacctcacgtggtcaataggcggctcagtacaccaactgggtcttgaccaagcacttctgttaccccggaccgagtatcaataggctgcccacgcggctgaaggagaaaacgttcgttacccggccaattacttcgagaaacctagtatcaccatggaagttgcgcggcgtttcgctccacacaaccccagtgtagatcaggctgatgagtcaccgcactcctcacgggcgaccgtggcggtggctgcgttggcggcctgcccatggggcaacccatgggacgcctcaatactgacatggtgtgaagagtctattgagctaattggtagtcctccggcccctgaatgcggctaatcctaactgcggagcagacactcacaagccagtgggcggtctgtcgtaacgggcaactctgcagcggaaccgactactttgggtgtccgtgtttccttttattcctacattggctgcttatggtgacaattgagagattgttaccatatagctattggattggccatccggtgacaaacagagcgattgtctattcatttgtcggttttgtaccattaaactccaaagtcttgaaaaccctcaacctaatcatcctacttaactcagtaaa

SEQ ID NO: 775 - DNA, 643 bp, Enterovirus sp.
  D68, isolate NY510_18 polyprotein gene, complete cds.1
ccaagggcccacgtggcggctagtactctggtacttcggtacctttgtacgcctgttttatctcccttcccaatgtcaataggtggggcgcaaaccagcgctctcatgagcaagcactcctgtctccccggtgtggttgtataaactgttcccacggttgaaaacaacctatccgttatccgctatagtacttcgagaaacctagtatcacctttggattgttgacgcgttgcgctcagcacactaacccgtgtgtagcttgggtcgatgagtctggacataccccactggcgacagtggtccaggctgcgttggcggcctactcatggtgaaaaccatgagacgctagacatgaacaaggtgtgaagagtctattgagctactatagagtcctccggcccctgaatgcggctaatcctaaccatggagcaagtgctcacaggccagtgagttgcttgtcgtaatgcgcaagtccgtggcggaaccgactactttgggtgtccgtgtttcactttttacttttatgactgcttatggtgacaatttgatattgttaccatttagctgtcaaattaattgcaaaagatcctaagtcttacttaccaatttgcattttgataaccttgatttgaaaattttaata

SEQ ID NO: 776 - DNA, 643 bp, Rhinovirus B
  strain 20692_64_HRV-B polyprotein gene, complete cds.1
cggataacgtttaaaacagcggatgggttcccccaccatccgacccactgggtgtagtactctggtattatgtacctttgtacgcctgtttactcccaaaccccccctcccgttacatttccaacccctgtaacgttagaagtttggaatttaacagtacaataggaggcaccatacccaatggtgtaatgtacaagcacttctgtttccccggagcgaggtataggtggtacccaccgctgaaagcctttaaccgttatccgccaatcaactacgtaacagctagtagcattttgtcgttgactggacgttcgatcaggtggtttacccccccactagtttggtcgatgaggctggaaattccccacgggtgaccgtgttccagcctgcgtggcggccaacccagctcatgctgggacgccctttcaatgacatggtgtgaagactcgcatgtgcttggttgtgaatcctccggcccctgaatgcggctaaccctaaccccggagccttgcatcgcaatccagtgatgttggggtcgtaatgagtaattctgggatgggaccgactactttgggtgtccgtgtttctcatttttctttgaattatcttatggtcacagcatatagtaatatatactgtgatc

SEQ ID NO: 777 - DNA, 644 bp, Picornaviridae sp.
  isolate thr106pic1 genomic sequence.1
gaaaagagtcccaggaggaattccccctgggaacccttttccgttgggaaggcttggcaaccttcctggcgttaggctgcttagtagtctgcgtattgcgcgccagtttggcttcggctgagctgccgttcaatacactagtgggctattctaggtggctgtagttgccctacagtggccggccagtgaaaccacactgtagtttacccctaccccaaaatctctaatttatgaccgtaatccctaagtgactttcttgtttgctctcacacatgggctttggatcttgttttggattttggtatctgatctctatctggatgtatcagtaatctgaagtgcggacgcaatccgcctagtaggatgactgttgtccttttagaggaaaacctctgtggctagacatagtggtgtatagattcaacaggactcctttttggatatcctaactcccggacccttgttgaatgggctggatttccgcctagccaagggaaaccaccggaacggggatggcaactgaacctagtacggctagtaggaggtctatacatacgatgggctgggaaacccatcctggactatgactgggtgatagcctcgcggcggatcgagtcacagttgtaatccgttgttttgcactc

SEQ ID NO: 778 - DNA, 644 bp, Human rhinovirus B
  strain HRV-B70_p1085_sR469_2008 polyprotein1
aattggcggataacggttaagagcttaaaacagcggatgggttccccaccatccgacccaatgggtgtagtactctggtattctgtacctttgtacgcctgtttctcccctccctcccatcctaaattgtcccagtaacttagaagacttgaattaccgtacaataggtgctgtcacatccagtgatggcttgtacaagcacttctgtttccccggagcggagtatagatggccaccgctgtcaaaagctcttaaccgttatccgccaattaactacgcaacggctagtaacatcttgttattcttagggcgttcgatcaggtgagtacacccctcactagtctggtcgatgaggctgagaattccccacgggcgaccgtgtctcagcctgcgtggcggccagcccagcttatgctgggacgccttaattgtgacatggtgtgaagacccacgtgtgcttaattgtgagtcctccggcccctgaatgcggctaacctaaaccctggagccttgagacacaatccagtgttggcaaggtcgtaatgagcaattccgggacgggaccgactactttgggtgtccgtgtttcctgttatttccaaattgttcttatggtcacaatataagctatatatattgtgatc

SEQ ID NO: 779 - DNA, 644 bp, Human rhinovirus C
  strain HRV-C42_p1053_s3040_1999 polyprotein1
cgaatccttgtagtaatttatgttaaagtacttgatgagacctccattggtggcagtaatagcattctcatgtgatccggtggtattccggtacacttgtacgccagtttgccaccctaaataccccgtaacaatagaagtctacacacacttagaccaatagggggtgttcatccagttcacccaaggtcaagcacttctgtttccccggcataggggtgttaggtttcacccgagactgaagctctgattgtcgttatccgcacaactactggacaaagcctagtaacaccctacgatgtaccatggttggttgttccgccagtaccccctggtaaacctggcagatggggctagaagttcctcactggtgacagtgttctagcccgcgtggctgcctgctcccttatgggagaagccattttactgacaaggtgtggagagccccgtacgctagttgtgactcctccggcccctgaatgcggctaatccaaccctgcagccattgcatggaagccaccatgtagatggtcgtaatgagtaattgcgggacggaaccgactactttgggtgtccgtgtttcttgtttttcttttactgacgtttatggtgacaatatatatataacatatatattgttcatc

SEQ ID NO: 780 - DNA, 645 bp, Human rhinovirus C
  isolate JAL-1, complete genome.1
ttaaaactgggcattggttgtccccaccaatgcacaccaagtgtgttagtgctctggaatcttcgttcctttgcacgccagtttgccctcccttccccaagtctttctatcattcttttcttcctaatgtaacttagacgttataccacagtccaataggacgtggccaatccaggccatgacggacaagcacttctgtctccccgggcgtgtgaggaataggcctcaaaaaggctgaagctgtagcgctcgttatccgcattggtactacgcgatggctagtatcatcctggaagtctcttggttggtcgctcagcgtggtaaccccccacgtagatcagggcaatgaggctgcatatgccccaccggcgacggtgatgcagcctgcgtggtgccccgcctgggttaacccccaggaagccaatgagtggacagggtgtgaagagccgcgtgtgctaccaatgagtcctccggcccctgaatgcggctaatccaaccccacagctatggcatgcaagccagcatgtgcgtagtcgtaatgagtaattgtgggacggaaccgactactttgggtgtccgtgtttcctttattctttgaaatgttgcttatggtgacaatattggtattataccattcttgtcatc

SEQ ID NO: 781 - DNA, 647 bp, Enterovirus C
  strain 04-1438, complete genome.1
tgtgacctcaccggggaaacagaagtgcttgttcgtggtggtactggtttgtaccaccacgaacaagcacttctgtttccccggtgaggtcacatagactgttcccacggttgaaagtgatcaatccgttatccgctcatgtacttcgggaagcctagtatcacctttggatcttcgacgcgttgcgctcagcactcaaccccagagtgtagcttaggctgatgagtctggacgttccccactggtgacagtggtccaggctgcgttggcggcctacctgtggttcaaagccacaggacgctagttgtgaacaaggtgtgaagagcctactgagctacctgagattcctccggcccctgaatgcggctaatcctaaccacggagcaggtgatcataaaccaatgataggcctgtcgtaatgcgcaagtctgtggcggaaccgactactttgggtgtccgtgtttccttttattctttacattggctgcttatggtgacaatcatagattgttatcataaagcgaattggattggccatccggtgaaaatcagagcgattatatatttgtttattggattcactccattaacaccaatttctcctacactcattaagctagtcctattaataaggtactattatcata

SEQ ID NO: 782 - DNA, 647 bp, Unknown
  Description of Unknown: Human coxsackievirus A22, strain BBD58 polyprotein gene, partial1
cggtacctttgtacgcctgttttatatcccctcccccatgcaactttagaagcaattcaaacagttcaatagagggggtacaaaccagtaccaccacgaacaagcacttctgtttccccggtgaagctgtatagactgtgcccacggttgaaaatggctaatccgttatccgcttaagtacttcgagaagcctagtatcaccttggaatcttcgacgcgttgcgctcagcactctaccccgagtgtagcttaggctgatgagtctgggcataccccaccggcgacggtggcccaggctgcgttggcggcctacccatggctaacgccatgggacgctagttgtgaacaaggtgtgaagagcctattgagctacttgagagtcctccggcccctgaatgcggctaatcccaaccacggagcaagtgctcacaaaccagtgagtggcttgtcgtaacgcgcaagtctgtggcggaaccgactactttgggtgtccgtgtttccttttatttttatcatggctgcttatggtgacaatctaagattgttatcatatagcgtttggattggccatccggtgatttcaaaagtgatatatttgacctatcgccttactgtgtttacctactcattacatccactcaaccata

SEQ ID NO: 783 - DNA, 648 bp, Coxsackievirus
  A1 clone V18A polyprotein gene, complete cds.1
tcacggtacctttgtacgcctgttttacatcccctccccaagtaactttagaagtaaatcataaagttcaatagaagggggtgcaagccagcaccaccacgaacaagcacttctgtttccccggtgaagccgtatagactgcccccgcggttgaaaatggcagatccgttatccgctcacgtacttcgagaagcctagtatcaccttggaatcttcgacgcgttgcgctcagcactctaccccgagtgtagcttaggtcgatgagtctgggcataccccaccggtgacggtggcccaggctgcgttggcggcctacccatggttaacaccatgggacgctagttgtgaacaaggtgtgaagagcctattgagctacctgagagtcctccggcccctgaatgcggctaatcccaaccacggagcaagtgctcacaaaccagtgggtagcttgtcgtaacgcgcaagtctgtggcggaaccgactactttgggtgtccgtgtttccttttatttttatcatggctgcttatggtgacaatctaagattgttatcatatagctattggattggccatccggtgatttttgaaagtgatatttgccttgctatttcattgcatttgcttacttataatactgcaaactcaca

SEQ ID NO: 784 - DNA, 648 bp, Rhinovirus B
  take1 genomic RNA, complete genome.1
tactaatacagagtactacacccagtgggtcggatgggtatcccaccatccgacccactgggtgtagtactctggtattatgtacctttgtacgcctgttcttcccattgtaccctccctaaatttccaacccaagtaacgttagaagttccacataacagtacaataggaagcaccacatccagtggtgttttgtacaagcacttctgtctccccggagcgaggtataggctgtacccactgccaaaagcctttaaccgttatccgccaaccaactacgtaaaagctagtaacatcttgtttgtaacttggcgttcgatcaggtggattccccctccattagtttggtcgatgaggctaggaattccccacgggcgaccgtgtcctagcctgcgtggcggccaacccagcatttgctgggacgcccttttatagacatggtgtgaagactcgcatgtgcttggttgtgactcctccggcccctgaatgcggctaaccttaaccccggagccttgtgttgcaagccagcaacattaaggtcgtaatgagtaattctgggacgggaccgactactttgggtgtccgtgtttccaatttttcttattattgtcttatggtcacagcatatttgacaaatatactgtgatc

SEQ ID NO: 785 - DNA, 649 bp, Echovirus
  E7, isolate Env_2016_Sep_E-7b, complete genome.1
ccaccccgtcgtaacttagaagctaatcaactatggtcactaggcggcccagtatgccaactgggtcttgaccaagcacttctgttaccccggactgagtatcaataggctgctcacgcggctgaaggagaaaacgttcgttacccggccagttacttcgagaaacctagtaccaccatgaaggttgcgcagcgtttcgctccgcacaaccccagtgtagatcaggccgatgagtcaccgcatccctcacgggcgaccgtggcggtggctgcgttggcggcctgcccatggggcaacccatgggacgcttcaatactgacatggtgcgaagagtctattgagctaattggtagtcctccggcccctgaatgcggctaatcctaactgcggagcagatacccgcgtgccagcgggcagtctgtcgtaatgggcaactctgcagcggaaccgactactttgggtgtccgtgtttccttttattcttacactggctgcttatggtgacaattgaaagattgttaccatatagctattggattggccatccggtgactaacagagcgattatctatcaatttgttggttttgtgccattggatttcccaaccctaagaacccttaattttatattggtacttaacacgacaag

SEQ ID NO: 786 - DNA, 651 bp, Gallivirus A1
  isolate 518C, complete genome.1
ggttaacttgtttaaccaaggcttccgtgcagggcttgcacgttaggagttcatgttgattcatgctccaatgcccaaaactttgtgtgtttgtttatgtctttcccaaagtttcccccaaggtttcggtactcaaaccttaattcctagtcccatcttttgggccttagtatctaggaaatgtacccgtgccttgacgaacgtaagaaagctgtcttttattgaacggttctaatgaactaagtataactggctcgcgccacctggtgtgtgccgttggaattcccccatggtaacatggtccaacgggcccgaaaggctagtgggcaatcggtcctccaaggaaggggttcccaccccgacctgaacaggatttgatgaagctcacctcccaggctcctaaccccaaggaagtttacttatagtaattagaatttagtatgtaattgctggcaatcttgctagtagtcaggaacgttatgaccaaatgagtagacccccagaaggtaccccattatatgggatctgatctgggcctcatactgtgtgtctccccacatatgaggttaaaaccatgaaagtttggtccaaaatattcttttccttttatcttttctttagtggtgacgccattatatcagcagtttgctg

SEQ ID NO: 787 - DNA, 651 bp, Human poliovirus 2
  complete virion genome,isolate1
ccccgtaacttagaagcataaaaccaagttcagcaggaaggggtgcaaaccagtacctctatgaacaagcacttctgtttccccggtgacattgcatagactgctcacgcggttgaaagcgatcgatccgttatccgcttgtgtacttcgaaaagcctagtatcgccttggaatcttcgacgcgttgcgctcagcacccgatcccggggtgtagcttaggctgatgagtctggacgtccctcaccggcgacggtggtccaggctgcgttggcggcctacctatggctaacgccataggacgctagatgtgaacaaggtgtgaagagcctattgagctacacgagagtcctccggcccctgaatgcggctaatcctaaccacggagcaagcggtcacgaaccagtggctggcttgtcgtaacgcgcaagtctgtggcggaaccgactactttgggtgtccgtgtttcctgttatttttatcatggctgcttatggtgacaatctgtgattgttatcataaagcgatttggattggccatccggtgagtgttgtatcgaacatttgactgttcatcagaactactgtgttagattcacttcttattcaactaattaatcaaaaacagtacgaagacaaaacaacaatactaca

SEQ ID NO: 788 - DNA, 651 bp, Human enterovirus
  isolate EV/Human/CMRHP52B/CMR/2014 polyprotein1
cccctaccccttgcaacatagaagcattgtaccacggatcaatagcaggtgtgtcgatccagacgcatcttgatcaagcacttctgttcccccggaccgagtatcaataagctactaacgtggctgaaggagaaaatgtccgttacccggccaactacttcgagaagcccagtaccaccatgaacgttgcagagtgtttcgctcagcacaaccccagtgtagatcaggccgatgagtcaccgcattcctcacgggcgaccgtggcggtggctgcgctggcggcctgcctatggggaaacccataggacgctctaatactgacatggtgcgaagagcctattgagctagttggtagtcctccggcccctgaatgcggctaatcctaactgcggagcatgtgctcacaatccagtgagtggcatgtcgtaacgggtaactctgcagcggaaccgactactttgggtgtccgtgtttccttttatatttatactggctgcttatggtgacaatcaaggaattgttaccatatagctattggattggccatccggtgactaatagagctataatttacctatttgttggattcgtccccctgaacacaaaaacagttcagactctacagtacatcttatttttgaacttgaagaa

SEQ ID NO: 789 - DNA, 652 bp, Enterovirus E
  strain NGR_2018, complete genome.1
gggggttgtacccacccctggggcccacgtggcgccagtactctggtacgctagtacctttgtacgcctgttttcccctcccgtaaataaatcaagattgctggtcctgtggggagtagtccgactccgcaccgatacgtcgcaccagtactccggtacgcctagtaccctagtacggaggtaccagtactcctctcccgtaacttagaagcaaagcaccaaaccgacccaaaaggacgcgttgcacccagcagcgtgatggtcaagcacttctgtttccccggccgcaaggtcgttacccacccgcaccactacgagaagcctattagacagccaagcttgcaaagcgttgcgttcaaccacaaccccagtggtagctctgagagatgggactcgtcgttcccccatggcaacatggtgacttgtccgcgtgtgctctcgggttcgccaataggcgttcacgccgcacaagtgtaactgttgaagagcctattgtgctggagcggttttcctccggagccgtgaatgctgctaatcccaacctccgagcgtgtgcgcacaaaccagtgttgctacgtcgtaacgcgtaagttggaggcggaacagactactttcggtactccgtgtttccttattttatattactcaatct

SEQ ID NO: 790 - DNA, 652 bp, Human rhinovirus A
  strain HRV-A44_p1191_sR1286_2009 polyprotein1
gagcctggtggagcgtatcaatctaaaccggggagacagaagtgcttgaccgttaatgacttggatagccatctcctacatggagttgtactctattattccggtaatcttgtacgccagttttatatcccttccccctttgtaacttagaagttaagcacacagaccaataggtgatggctatccaagtcattaacggtcaagcacttctgtctccccggtttagattgatacgctccaccagggcgaaaacaatctaaatcgttatccgcaaagtgactacgcaaagcctagtaataccttgaagaacttatggttggtcgctccactaaaccccatagtagacctggcagatgaggctagaagtaccccactggtaacagtgttctagcctgcgtggctgcctgcacaccctttgggtgtgaagccatatttttgacaaggtgtgaagagccccgtgtgctcactttgagtcctccggcccctgaatgtggctaaccttaaccctgcagctagtgcatgcaatccagcatgttgctagtcgtaacgagcaattgcgggatgggaccaactactttgggtgtccgtgtttcactttttaccttttatttgcttatggtgacaatatatatagtacatatatattggcatc

SEQ ID NO: 791 - DNA, 654 bp, Simian enterovirus J103
  isolate cg8227 polyprotein gene, partial1
tttgtacgcctattttaaaacccctacccccgtaacttagaagcatttgacacaagttcaatagtaggaccatcatccaggtggttcatcgaacaagcacttctgttaccccggtcctagtacctgtgaagctgtacccacggcggaaggggaaaacgatcgttacccggctatctacttcgagaagcctagtaacagcattgaaactcttgagcgttgcgttcagcacagtaacccctgtgtagctttggctgatgagtctgggcattccccactggcgacagtggcccaggctgcgttggcggccaaccgatccgggcaaccgggtcggacgcttatttgtggacatggtgtgaagagcctattgagctagatagtagtcctccggcccctgaatgcggctaatcctaactccggagcaaatgcacgcaacccagcgtgtagtttgtcgtaacgcgtaagtctggagcggaaccgactactttgggtgtccgtgtttcctgttttaccttatttggctgcttatggtgacaatatagtattgttaccatatagctattggattggccatccggtgaacagatttcgacaaactctattttactgttgttcacagcctaaagttacaaatcttactctgactcagtagtaatc

SEQ ID NO: 792 - DNA, 655 bp, Human parechovirus 1
  isolate 152478, complete genome.1
ctggatttctctaggagagtccctttcccagccctgaggcggctggtaaataaaagcctcaattgtaacaaacatctaagaacactacattaaccccatgcctggtctccactagttgaaggcgacttgcaataagatgagtggaaacaagacgcttaaagcatggtgtaaatcaacttttctaacctgtacattgtatggggtggcagatggcgtgccataattctatcagtgagataccacgcttgtggaccttatgctcacacagccatcctctagtaagtttgtgagacgtctggagacgtgtgggaacttattggaaacaacattttgctgtaaagcatcctactgccagcggaacaacacctggtaacaggtgcctctggggccaaaagccaaggtttaacagaccctctaggattggtttaaaacctgagatgttgtggaaaatattcagtacctaccaatctggtagtagtgcaaacactagttgtaaggcccacgaaggatgcccagaaggtacccgtaggtaacaagtgacactacggatctgatctggggccaggtacctctatctaggtgacctggttaaaaaacgtctagtgggccaaacccgggggggaccccggtttccttttattttatcaatgccact

SEQ ID NO: 793 - DNA, 655 bp, Simian enterovirus 46
  isolate cg4119 polyprotein gene, partial cds.1
ctgttttatctcccctcccccgtaacgttagaagattaaacaaatgacaaatagcaaatccaccaacccaggtgggttttcgtcaagcacttctgtttccccggacctagtaccaataggctgtacccacggctgaaagggaaaacgttcgttacccggctacctacttcgagaagcctagtaccatcattgaatgtctcaagtgttacgctcagcacaaccccagtgcagttcaggctgatgagtcaccgaatcccccacgggcgaccgtgtcggtggctgcgttggcggcctgcctgcgagttccactcgcaggacgcttgattcatgacatggtgcgaagagcctattgagctaggtagtagtcctccggcccctgaatgcggctaatcccaaccacggagcatccactgacaaaccagtcagcagggtgtcgtaatgggcaactctgtggcggaaccgactactttgggtgtccgtgtttcctgttttatttactctggctgcttatggtgacaatttacggattgttaccatatagctattggattggccatccggattacaagcaagtaatattactgtttgtgggatttttacccttgaatcacattaactacttcattctactaatagtcttgaagttaagtacatc

SEQ ID NO: 794 - DNA, 656 bp, Rhimavirus A
  complete genome.1
cgaattccggacatctcctttcgggggcgagcgtcaccgtgcccctcatggaggcaactgtgcctctaatcggtgacccactgagaaaattttctttctacgtggctaaacaatgcaactttataataacacaaatttaatgcttaatcttaacaccaaagatttgaacatatgtttggaaagtggcacacttcaaacattgcatagttgctaggggtgaagtccctttaaggggttgcagaggatctttcctctttatgagcggctaggagtatcttcttgatattatgtggtcgtgcaactcacttcccagatgtatgacggtgtactaagcgattggaactagtcataacctctttgaattttggtattgcgagtctagcagggggatatttaccgctaaagggtgacacactcgtgagggtggcctttggtgtgtgtatatttattccgcccatcttgcatggggtgctaaaattctaatgctgtgaaataaccattttctgaatacattctctacatttggagtcaaatatgaggaatgccactcaggtacccttgacatgatcttggatctgagagtgggctaattatctaattatttggcgactttctaaaatcttctgtttttagtggtgacaatttatggttataaa

SEQ ID NO: 795 - DNA, 656 bp, Rhinovirus C
  strain 20693_83_HRV-C polyprotein gene, complete cds.1
gaaaggaggggaaggggttttaaaacagtcgaccggttgttcccaccggcgagcacactgtgcgttgtacactggaattacggttcctttgtatgcctgttttataaccccttcccctcctttctatcacctctaacttccatgtaacttagaagcaacgtacatgagcccaataggagcggctaatccacagccgtatagggcaagcacttctgttaccccggatgtgtgaatagacttctcacgaggttgaagctgaagcattcgttatccgcgcttgtactgcacggaaattagtagcactcttgccagcctcatggtgtttcgctcagcgtttcccccacgtagatcagggcaatggggctacacaacccccaccggcgacggtggtgtagcccgcgtggtgccccgcccgagctactagctcgggacgccatgatgaagacagggtgtgaaggttcgagtgcgctacaagtgagtcctccggcccctgaatgcggctaaccttaaccccgtagctgtggtgtgcatgccagtacaaacacagtcgtaatgggtaactacgggatgggaccgactactttgggtgtccgtgtttcactttttcctttaaatttgtcttatggttacaggtttatgcaaatagatctgtaatc

SEQ ID NO: 796 - DNA, 657 bp, Human enterovirus 73
  isolate 2776-82 polyprotein (pol) gene,1
gcggccccctcccccactgtaacttagaagcaatgcataccgatcaacagtgggcgtggcaaaccagccatgtcttgatcaaacacttctgtttccccggactgagtatcaatagactgctcgcgcggttgaaggagaaaacgttcgttatccggccaactacttcgagaagcttaagtaacatcatgaaagttacggagcgtttcgttcagcacatccccagtgtagatcaggccgatgagtcactgctctccccacgggcgaccgtggcagtggctgcgctggcggcctgcccatggggtgacccatgggacgctctaagatggacatggtgcgaagagcctattgagctagttggtagtcctccggcccctgaatgcggctaatcccaactgcggagcatgtgtcttcactccagaagatagcatgtcgtaacgggcaactctgcagcggaaccgactactttgggtgtccgtgtttccttttattcctacactggctgcttatggtgacaattcaagaattgttaccatatagctattggattggccatccggtgagcaatagagcaattatctaccaatttgttggatttgtacccctcgattttacagccattggaacacttaaatacatcttagtactcaacacgacaaa

SEQ ID NO: 797 - DNA, 660 bp, Enterovirus SEV-gx
  complete genome.1
acatgggccagcccaccacacccactgggtgtagtagtctggttctatggaacctttctacgcctcttttgcttccctcccccatttctccttcgattgctccacctgtgatctttgcaacttagaagaaataatgaacccgcacaatagcgggcgctgagccacagcgtcaatgtgcaagcacttctgtttccccggaatgggcccataggctgtacccacggctgaaagggaccggcccgttacccgccttggtactgcgagaatgttagtaactccctcgatagctttaggcgttacgctcagccctttgagcccgaagggtagttcgggtcgatgaggctcgtcattccccactggcgacagtgtgacttgcctgcgttggcggcccggggtggggggcaacccccatccacgcctactgaaggacagggtgtgaaggcgctattgcgctactaaggagtcctccggcccctgaatgcggctaacccgaaccccgagcccacggtggtaaacccgccacaagtgggtcgtaatgagtaatttggggcagggaccgactactttgggtgtccgtgtttcctgtttttccatacgatggctgcttatggtgacaaccataagcaattggattggccatccggtgttcatattgcgaat

SEQ ID NO: 798 - DNA, 662 bp, Encephalomyocarditis virus
  isolate SG-G15150-19, complete genome.1
ctctttccgagggaaaggaagcgccccagtctgcattcacaagctggtgcttccccgcccagactaagcgccgcacggagggaatcagggtcccggtgccccccctccctaacagtactggtcgaaaccacttgggataagaccggtgtcttgtttagtctatatgttatttctactcatctggtttctttgccagatgatgggcagtgtaaccttgccctcgcttcttgcggagaattcctagtggtctttccactctcgacaaaggaattcatgttccaccaaaagttgtgaagaaagcaagtcctatggaagctttctgatgactgatgatgactgtagcgaccctttgcaggcagcggactcccccacctggtaacaggtgcctctgcggccaaaagccacgtgtttgacagacacctgcaaaggcggcacaaccccagtgcctcatcaaaagtctgatgactgtggaaatggtcaactggcttttcttaagcaaatttggtgtttggggctgaaggatgcccggaaggtaccacactggttgtgatctgatccggggctttagtgcatgtgctttacacatgtagctaaggttaaaaaacgtctaggccccccaaccacggggacgtggttttcctttgaaaaccacaatttataat

SEQ ID NO: 799 - DNA, 663 bp, Norway rat hunnivirus
  isolate NrHuV/NYC-E21 polyprotein gene,1
gccctcacctgtcaattgggaccaccactttcagtgaccccatgcgaagtgctgagagaaggaagctttcttacccttcatttgtgaacccactagtctaagccgcttggaatacgatgagtggaaaagttcattctaaatggagtgaaacatgcttaatttttctagtcaggcacacccttgtgtgtctgagcgccactgtcttggcgtaagtcttcagagtgtcacgccgtgcttgcggatctcacgtggcacatgacgaggctctcgctggaactgtgagtctggaacaagtgaagtaacagtgaaaagtgcatgatcacacattgtgtgggctatgagcctgcggaacaacaactggtaacagttgccccaggggccgaaagccacggtgttaacagcaccctcatagtttgatccatcccaggatggtgatgttgtgtacctagtaattgccaatttgcttgttttggtatcatggcataccggagagtttgcgggtgaaggatgcccagaaggtacccgtaggtaaccttaagagactatggatctgatctggggccctgtctggagtgctttacacacagctcagggttaaaaaacgtctagcccgcatcaacccgagggattcgggttttccctttaaaaacccgactggcattt

SEQ ID NO: 800 - DNA, 663 bp, Human enterovirus 109
  isolate NICA08-4327, complete genome.1
tttaaaacagcctgggggttgttcccacccccagggcccactgggcgttagtactctggtatcgcggtaccttagtatgcctgttttatgtctcctttcccccgcaactttagaagtaatcaagttatggctcaacagtcgccacacccccagtgtggttccgagcaagcacttctgttccccggttgcgtcttatatgctgtgtgaacggcagaaagggacaatatcgttatccgctcaactactacgggaagcctagtaccaccatggattgacctgaaagttgcgttcagcgcacccccagcgcagctcaggccgatgaggctccgaataccccacgggcgaccgtgtcggagcctgcgttggcggcctgcccacgttgcaaaacgtgggacgctcatttcatgacatggtgcgaagagcctactgtgctagttgagagtcctccggcccctgaatgtggataatcctaaccactgaacctacgggcgcaaaccagcgtctggtaggccgtaacgcgcaagtcggtggcggaaccaactactttgggtgtccgtgtttccttttatctttttgaatgtttatggtgacaattgttgtgtacagttgttaccatagtttgcattcagaaataaacctaacactttccaattatttgttaca

SEQ ID NO: 801 - DNA, 664 bp, Swine picornavirus
  Tottori-WOL gene for polyprotein, complete cds.1
cccctttacgtaactgcaacttaaagagtaccctactgcattggatgtgtggtaaacttttacgcacacatttgtagtagtgttagttatgttctacctaatgagtatgcatgcacccgtcgaaacacgcttgtgataagataggtgagtccatgtgactaatctcattaagataaataagcaccctacaacgcacggcacgctcgtgtcttccgtgcggggccgggacaacagcggcctaaatcttctaggtgaccaccatgcttttgggactatggcaccactgtggacgtgagtacctggcagtaagtctgtgaaaagatggaaggtgtcccaagctatggggcgtatgcatatagcctgcggaacaaacaacggcgacgttgtccccagggcccaaaaggcacgtggataagatccacctatatgtttaccccatagtgtaagtcactggaagtcctagtaatggatgtctggagtaaggctcacggggtagggcgaaggatgcccagaaggtacccgtaggtaaccttaagagactatggatctgatctggggaccggatggcgccatcaccatgacgtggaggccggtttaaaaaacgtctaagcccgaccaacaacctaggggactaggttttccttttttattcatgtatgacgtt

SEQ ID NO: 802 - DNA, 664 bp, WUHARV Enterovirus 1
  polyprotein gene, complete cds.1
ccacgcggcgttagtactctggtatcacggtacctttgtatgcctgttttatctcccttcccccgtaacgttagaagaaaacacaaccgacaactagcagattcaccaatccaggtgagtcttcgtcaagcacttctgtttccccggacttagtaccaataggctgtacccacggctgaaggggaaaacgttcgttatccggctacctacttcgagaagcctagtaccaccattgaatgtctcaagtgttacgttcagcacaaccccagtgtagttcaggtcgatgagtcaccgaattccccacgggcgaccgtgtcggtggctgcgttggcggcctgcctgcgggtttcacccgcaggacgcttgattcatgacatggtgcgaagagcctattgagctaggtagtagtcctccggcccctgaatgcggctaatcctaaccacggagccatgcgttacaatccagtaacgttgtggtcgtaacgagtaattctgtggcggaaccgactactttgggtgtccgtgtttcctgttttactcattttggctgcttatggtgacaatctagggttgtcatcatatagcgattggattggccatccggatttgtctttgtgtgatttatctcttgctcacaagcaattttcataggtcatagcatcatc

SEQ ID NO: 803 - DNA, 665 bp, Pelodiscus sinensis picornavirus 1
  strain CNSR2011, complete1
ttcaaatggcccctgggttgatacccagtggtcatttggacactttggtaaggaggtgtaattatccttcccatgtggaacctagtgcttaggtttactttatatgttctttgtttgtcctttgtactttctatcgggcaatcttgttgttcaatacaatatgtatttgaactgcctaagataaattcagttttcaaccaacccctctcttggggttgtgtctttctttctttcttatatcctcttaagctgacttacttgctaatccgactcctcgtcaacgggagggtaaagcagtatcactagggtattgtgatgtaggagaaaaagtaagtagagatagtgcatgtaacgaaagtgacttggtactttaaactctcttaatcccaaagtgtggtattggtcatgttggagtaggctacgggtgaaactccttcacatttagtaatgtgttcacacgctaacgctacggtagatgacagactaggtcttattctcaacgtagggggacgggtgtatgttcatgattagccacatattaaggttttgaggggctgagtcatataagtatgtgcattaatttctggtactggtccctggggactggcccttttctaggttgattttagtttccccaatttttaaaaactaatgagatttacgac

SEQ ID NO: 804 - DNA, 666 bp, Niviventer confucianus hunnivirus
  strain Wencheng-Nc42-11
cggcggctgagatgatgttcattctaatggagtgaaacatgtctttgattttctagtgcgtgttaggctttctagcacgcagcggcactgtcttgccgtaactctccagaccgtcacgccgtgcttgcggatctcacgtgccggatgacaaggctgtagctggaactgagtgtctagtgcacattgtgtaacagtgaaaactttgtgatcaccgaaaggtgggctagtagcctgcggaacaacaactggtaacagttgcctcaggggccaaaagccacggtgttaacagcaccctactagtttgatggaagcaattcctgatgttgcagagctagtaattgccaagctttgtacattagtatctcggcataccgtgcagtctgtgccagtgaaggatgccctgaaggtacccgtaggtaaccttaagagactatggatctgatcaggggctctctccgtactgctttacaggcggctgagagttaaaaaacgtctagctggccccagcccaagggattgggctttccctttaaagcccacaactcgcatatggtgacaataattgctgttcagacgaacagtgttattgttgtctattctcagagctttttccagacgcactcacacaacggaacttcttggcaagcaaatccaacaacagtcaat

SEQ ID NO: 805 - DNA, 666 bp, Seneca valley virus
  isolate SVV-001 polyprotein gene, complete cds.1
tttgaaatggggggctgggccctgatgcccagtccttcctttccccttccggggggttaaccggctgtgtttgctagaggcacagaggggcaacatccaacctgcttttgcggggaacggtgcggctccgattcctgcgtcgccaaaggtgttagcgcacccaaacggcgcacctaccaatgttattggtgtggtctgcgagttctagcctactcgtttctcccccgaccattcactcacccacgaaaagtgtgttgtaaccataagatttaacccccgcacgggatgtgcgataaccgtaagactggctcaagcgcggaaagcgctgtaaccacatgctgttagtccctttatggctgcaagatggctacccacctcggatcactgaactggagctcgaccctccttagtaagggaaccgagaggccttcgtgcaacaagctccgacacagagtccacgtgactgctaccaccatgagtacatggttctcccctctcgacccaggacttctttttgaatatccacggctcgatccagagggtggggcatgacccctagcatagcgagctacagcgggaactgtagctaggccttagcgtgccttggatactgcctgatagggcgacggcctagtcgtgtcggttctataggtagcacatacaaat

SEQ ID NO: 806 - DNA, 666 bp, Simian enterovirus SV4
  strain 1715 UWB, complete genome.1
ttaaaatagctgctgggttgttcccatccagcaggcccactgggcgtgatactctggtattgcggtacctttgtatgcctattttacctcccttccccctgaaacttagaagaaagaaacaaacacgctcactaggtacactgcatccagcagtgtaatgagcaagcacttctgtttccccggaagggatatatggtacgctgtgcaaacggcggaaattaatcctaccgttaaccgcccatctactccgagaagcctagtacctaattgaacttatcaatggagttgcgctcagcaggtgaccctgacctgccagctccggctgatggacctgggcatcccccacaggcgactgtggcccaggtcgcgtggcggccggcccactcttttgagtgggacgccttgataatgacaaggtgggaagagcctattgggctagctggtttcctccggcctcctgaatgcggctaaccctaaccccggagcatatggtggcaacccagccactggtatgtcgtaacgcgtaagtctgggatgggaccgactactttggagagtccgtgtttccattattttctttattgaatcttatggtgacaaattgggagttactcgggtgacgattgattattacttctgaaaacgtagagatatagaatcaacaca

SEQ ID NO: 807 - DNA, 667 bp, Picornaviridae sp.
  rodent/RL/PicoV/FJ2015 polyprotein gene,1
gggtttctctgccctgtgctttggacgcccgccatggcgttaaactggcaatccccccttttccctacccgtaactaagtttttcctcggtcctttaggctgctaagacgcttgttgctacagcatattggaaccaccgagtcctccataagtaatcatttccacctctttgggtgtctatgcccttagagacggtttggagccccgttgactatgtcagagtgtgtcggtagcaggctttctgctctggacccatgccggccacacctcccagtagtgttgtgaaggaagtaagggattagtgaaaagattaggaatgttgccttggaatgtagcgattactgtaggtgagcggacttccccgggtggtaacacccgcctctcaggccaaaagccacggtgttaacagcacccctacagtaggccactaccccgtggtctccaagaatacagacctcttcttagtaactatccccctagctttcctgaagcatgctgctgtaaaggctaaggatgccctgaaggtacccgcaggtaacgttaagacactgtggatctgatcaggggcttgagtactgaagctttacagaagtagctcaagttaaaaaacgtctatgcctttcccccacgggagtgggggttcccccacacaatttcaacaggcact

SEQ ID NO: 808 - DNA, 667 bp, Canine picornavirus
  strain 6D, complete genome.1
ttatttttcaaaatgccactggcattacaccatattcgtatggtgtaatgtcagtggttggatgctcagtcctgagggactgtgcatccagtggttaagagccacattctttatttatcaactattgatctttgtaactaagtttaagccagagttctattatggttccacatccagtgggattcagaacaagtacttctgttaccccggtcattattagctgttaagacgtacccacgtctgaaggctgagaagatcgttacccggctgttgtctacgggaaggttagtaacttttagtgaaaggtgatttcattgatccgagaggtgaccccgacctctcagaaactagtgatgagtgtccacatccctcttatggtaacataaggtggtcgctgcgctggcactagggcccaaaaggcatgaatgaaccaagatctgattgtgaagacccaactgtgcacttcagtattcctccggcccctgaatgcggctaatcctaacccatctgcatgtgcctacaacccagtaggtagcatgtcgtaatgcgtaagagatggatggaaccgactactttgggtgaccgtgtttcttttatttttatcaagtctcttatggtcacaagcatagaaaacaagatgcctgtgatcacacgtgagacatccaat

SEQ ID NO: 809 - DNA, 667 bp, Human parechovirus 17
  isolate 157Chzj058, complete genome.1
cttgtttccactcattttattgcaagttgccttcaactagtggagaccaggcatgaggttaatgctataatcttagatgtttgttacagttgaggtttttattaacctcatgcctggtctccactagttgaaggcaacttgcaataaaatgagtggaaacaagacgcttaaagcatggtgtaaattagcttttctaacccacactttgtgtggggtggcagatggcgtgccataactctattagtgagataccacgcttgtggaacttatgctcacgcagccatcctctagtaagtctgtgagatgtctggtgacgtgtgggaacttattggaaacaacattttgctgtaaagcatcctattgccagcggaacaacacctggtaacaggtgcctctggggccaaaagccaaggtttaacagaccctttaggattggttcataacctgaaatgttgtggaagatacttagtacctaccgatctggtagtattgcagacactagttgtaaggcccacgaaggatgcccagaaggtacccgtaggtaacaagagacactatcgatctgatctggggccaggtacctctatcttggtggcctgttaaaaaaacgtttggggggccagcccggggggggtccccgggtttcttttatcttacaactgctata

SEQ ID NO: 810 - DNA, 668 bp, Picornaviridae sp.
  isolate cra070pic1 genomic sequence.1
ctgtctcttatacagatgtcagtcagccaacaggctggctgggatgtgcccattttggacgcatgcccccgcgagagtggggcaccttgggggcgggtgagccccccatgttcgccaggtgttactgtcggcccttttatagaggcttttgtgggtatcagaagccgtttttgggtttggtgatggcgaccagcattgtcttgctggttgtgactgtctttttctcctgtttcttttcttattatctccaggctgtctccatgccaatgctgctaccgctgcgcccggcggggttaacccctggattagccaggggctgtggccgctagaagtggagatgcggtgactaatgtagtgtcatgggtaattgatgaggtcatggctgtggtgtggattggtgatcttccattgggggtaggctacgggtgaaacccccacgattgcaccatactatgtatggtgtccggtggtacgtgaaccccctggataggtttgagttttacgacaagaaagcctcaacagggagcgcaggcacggtacgcgtggatgcgccctccactaagcagtcatgcatcatttgttgtctgtcacactactaagccgtaccctatgagtttagggctactcaggggcatttaggtttttaaagcgcatgttgtaaatcactt

SEQ ID NO: 811 - DNA, 671 bp, Human parechovirus 1
  isolate 2007-863, complete genome.1
cgtcgggccttataccccgatttgctgagcttctctaggagagtccctttccccagccagaggtggctggtcaaataataccaattgtaacaaaacatctaagatacaacaaccacacacctggtctccaccagtcgaaggcaactagcaataagataggtgggttgagacgcttaaagtgtgtagtacatttacttttccaacctgtgctttgcacagggtggcagatggcgtgccataactctaatagtgagataccacgcttgtggaccttatgctcacacagccatcctctagtaagtttgcaagacgtctgatgacgtgtgggaacttgttggaaataatagtttgctgtaaagcatcccattgccagcggaatcacatctggtaacaggtgcctctggggccaaaagccaaggtttaacagaccctttgggattggttcaaacctgaactattatggaaaatatttagtacctgccgatttggtagtagtgcaaacactagttgtaaggcccacgaaggatgcccagaaggtacccgtaggtaacaagtgacactatggatctgatctggggccaactacctctatcttggtgagttggttaaaaaacgtctagtgggccaaacccgggggggaccccggtttccttttatttaataatgccact

SEQ ID NO: 812 - DNA, 672 bp, Ista virus
  isolate OTU18 RNA-dependent RNA polymerase gene,1
gggagagcttattgctctcccgccgtcttgcctatctataggtccaatctgtgtgatattccctaattaattaggtttgtcagttttcagatggatataatagtcattaatttatatttaatcatattagttcaaagggctataacttacccctgaatagtaacaaaatataaaatactcggtaccgaccggggtccgatctaatactaattattatatgatttgaccttatgataagttcaagaagtttctcttgattccagataaacccccctggaatttccccttatctttttcatataataactagtaatttcggatgcataaatactagttgtaagtcaaggtataattattaaaccgaacatttaattacttattagcactaatgaatgcccccatataaatagttatgggtatgagttcgcgattttcaacaacgatgcatgatttagagtaatgttaataagtgattttattagtaaagttttctaatgtatatgtcggcagttgcctacaacacgttaacctctgtgttaaaacctcgatgatatgtttatccatagacttcgggcatatacttctaaagtatgcgtgttcttctgaaaactcggtatgattgtcgcatgagtaagatagcgttccaatcaattccttttaatttctttcacg

SEQ ID NO: 813 - DNA, 672 bp, Senecavirus A
  isolate Sichuan HS-01, complete genome.1
ccctttttgaatggggggctgggccctcatgtccagcccttcctttccccttccggggggtaaaccggctgtgtttgctagaggcacagaggagcaacatccaacctgcttttgtggggaacggtgcggctccaattcctgcgtcgccaaaggtgttagcgcacccaaacggcgcatctaccaatgctattggtgtggtctgcgagttctagcctactcgtttctcccctgctcactcatttacacacaaaaactgtgttgtaactacaagatttggccctcgcacgggatgtgcgataaccgcaagactgactcaagcgcggaaggcgctgtaaccacatgctgttagtccctttatggctgcgagatggctatccacctcggatcactgaactggagttcgaccctccttagtaagggaaccgagaggccttcccgcaacaagctccgacacagagtccacgtgattgctaccaccatgagtacatggttctcccctctcgacccaggacttctttttgaatatccacggctcgatccagagggtggggcatgatccccctagcatagcgagctacagcgggaactgtagctaggccttagcgtgccttggatactgcctgatagggcgacggcctagtcgtgtcggttctataggtagcacatacaaat

SEQ ID NO: 814 - DNA, 672 bp, Human enterovirus C117
  strain LIT22, complete genome.1
tttaaaacagcttgagggttgttcccaccctcaaggcctactgggcgctagtacaccggtatctcggtacccttgtacgcctgttttatcttccctccccaaaagtaactttagaagcaagtaaactcacagctcaatagccgtcgcaccgccagtgcgactatgagcaagcactcctgtttccccggttgcgtcctatatgctgtggaaacggcagaaggggacaatatcgttacccgcttatctactacgggaagcctagtaacaccattgaacactttgagggttgcgttcagcgccaaacccggcgtagctcaggccgatggggcttcggaatccccacgggtgaccgtgtcgaagcccgcgttggcggcctgcccacaccaatgggtgtgggacgctcaatttgtgacatggtgcgaagagcctactgtgctaggtgagagtcctccggcccctgaatgtggctaatcccaaccaccgaacccgtggttgcaatccagcaactagcgggccgtaatgcgcaagtcggtgacggaaccaactactttgggtgaccgtgtttcctttatctcttatattgcaattttatggtgacatttatagtatttaagtgttaccatatattgcgcaaacatattgtaataatacagagttactactgcagaaatc

SEQ ID NO: 815 - DNA, 673 bp, Falcovirus A1
  strain kestrel/VOVE0622/2013/HUN, complete genome.1
taaaaggggacgcggtgtggcagctttggctgtcatgccgtgttctccttttaccccaaggactagccttgggggttttccaaattcctttccctgtaggctttacttctctttatctatcttttctgtaactaagttttgcctattctaaaaatattttagaatgtgtttggatgtaactaagtttgtgcctgccctaaaaatattttagggcttgtttggataacctcgtcccttgtgttcagtgccgcacaatttgctaggcactgttcacttcctttgtttgtccattatgtatgctaaggtatgaattccatcatatgcttagcctctacatgcataatcttattccctccctggtgcaaactacgcccccaacatatgtgaatcttttaagcatattcctgaccccacacatatatatgtgttctcgtgaattcccccaccgtgaggtggtcacttggacgtggtgtgtgtcacacagcatatatatgatgcaggatgttgtttttaagataagcatatgtccttagtgctttgcatcatttcctccacaccccgtgaatgcggctaatcttaaccctgttgggtccgtgggtaaaccaacccattaaccacaggacggaaccgactactttcgggagtgtgtgtttctttttcttcttttgtcact

SEQ ID NO: 816 - DNA, 673 bp, Enterovirus J
  strain Sev-nj1, complete genome.1
agggcccacgtggcgtagtactctggtatcacggtacctttgtacgcctattttacccccccttccccattgtaacttagaagataatcaaacagttcaatagtcgggctgccacccaggtagcttactgaacaagcacttctgttaccccggtcttagtacctgagaagctgtacccacggcggaaggggaaagtgatcgttacccggctatctacttcgagaagcctagtaacaccattgaacttgctgagtgttgcgctccacacagtaaccccctgtgtagctttggctgatgagtctgggcattccccactggcgacagtggcccaggctgcgttggcggccaaccgatccaggcaactgggtcggacgctgagtaacggacatggtgtgaagagcctattgagctagatagtagtcctccggcccctgaatgcggctaatcctaaccccggagcaggtacgcacaatccagtgtggagcctgtcgtaatgcgtaagtccgggacggaaccgactactttgggtgtccgtgtttcctgttttatttaccttggctgcttatggtgacaaactagtgttgtcatcatatagcgtttggattggccatccggttttgtacacgagtgtttcactacccgagactctatcacctctaccttattgagaaaa

SEQ ID NO: 817 - DNA, 675 bp, Human enterovirus
  isolate EV/Human/CMRHP35A/CMR/2014 polyprotein1
gtattggtactggtttatactcccttcccctgtaacttagaagatataaaccaagttcaatagaagggggtacaaaccagtaccaccacgaacaagcacttctgtttccccggtaaagttgcatagactgtacccacggttgaaggcgactgatccgttatccgctcttgtacttcgagaagcctagtaacatcttggaatcttcgatgcgttgcgctcatcactcaaccccagagtgtagcttaggtcgatgagtctggacattccccaccggtgacggtggtccaggctgcgttggcggcctacctgtggtccaaagccacaggacgctagttgtgaacaaggtgtgaagagcctattgagctacaagagagtcctccggcccctgaatgcggctaatctcaaccacggagcaagtgctcacaaaccagtgagtggcttgtcgtaacgggtaactctgtggcggaaccgactactttgggtgtccgtgtttccttttatttttataatggctgcttatggtgacaatcacagattgttatcataaagcgaattggattggccatccggtgaaagtgagatatattatttatctttttgttggatttactccgattacttctttcacttacaaaatcatcaccacagttttgctaattagaaatacataccata

SEQ ID NO: 818 - DNA, 679 bp, Enterovirus C
  isolate 5-05 polyprotein gene, complete cds.1
ggtacctttgtgcgcctgttttatactcccttccccgagtaactttagaagcaattcaacaagttcaatagagggggtgcaatccagcgccaccacaacaagcacttctgtctccccggtgactttacataagctgtacccacggctgaaagtgaatgatccgttatccgcttgtgtacttcgagaagcctagtaccaccttggaatctccgacgcgttgcgctcagcactctaccccgagtgtagcttaggttgatgagtctgggcattccccaccggcgacggtggcccaggctgcgttggcggcctacccatagctaacgctatgggacgctagttgtgaacaaggtgtgaagagccgattgagctactcaagagtcctccggcccctgaatgcggctaatcccaaccacggagcaagtgccttcaaaccagagggtggcttgtcgtaatgcgcaagttcgtggcggaaccgactactttgggtgtccgtgtttccttttattccattactggctgcttatggtgacaatcatagattgttatcataaagcgacttggattggccatccggtgaaatataaacacattgtctacttgtttgtcgggtttaccccactcactcagtccaccctcagcataataaacattgtgtcactgataagatattactactaca

SEQ ID NO: 819 - DNA, 682 bp, Human echovirus 1
  polyprotein precursor, gene, partial cds.1
ggtacctttgtgcgcctgttttatatacccttccccctctacagtaacttagaagtttgaatcatacggtcaatagacaacccagtgcaccagctgggccctgaccaagcacttctgttgccccggaccgagtatcaataagctgctcacgcggctgaaggagaaaacgttcgttacccggccatttacttcgagaaacctagtaacaccatgaaggtagcgcagcgtttcgctccgcacaaccccagtgtagatcaggtcgatgagccaccgcactccccacgggtgaccgtggcggtggctgcgttggcggcctgcccatggggcaacccatgggacgcttcaatactgacatggtgcgaagagtctattgagctaaatggtagtcctccggcccctgaatgcggctaatcccaactgcggagcagatacccacacaccagtgggcagtctgtcgtaacgggcaactctgcagcggaaccgactactttgggtgtccgtgtttccttttattctcacattgactgcttatggtgacaattgaaagattgttaccatatagctattggattggccatccagtgacaaacagagcaattgtgtatctttttgttggtttcataccactgaactgcaaagttttgaaaacccttgacctcattttgctactcaacacaacaaa

SEQ ID NO: 820 - DNA, 683 bp, Caprine kobuvirus
  isolate 12Q108, complete genome.1
tttgaaaagggggtggggggggcctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 821 - DNA, 683 bp, Foot-and-mouth disease virus
  - type SAT 2, isolate ZIM_22/20031
cccccccataaagaacgttaccgtcttttccgacgttaaagggatgcaaccaaacgcctcttaccgtcctttccgacgttaaaggattgcaaccatacgacttgccttcttttccgaagtaaaaggatacaagcatacagttttgcccgttttcatgagaaatgggacgtccgcgcacgaaacgcgccgttgctctttgcattcttgtacaaacacgatcttgacgcaggaatcctagaccaacccaacccgtgcaactgcgagtttcgcccggtctttccgggtcttgagagacaaacagatgtactgagaccaactccacgattggtctactagcgggtactagtaacactcattttgcttcgtagcggagcacatgagcggtggggactcccccatggtaacatggacccaccgggccaaaagccacgcctcacggcctcatgtgtgtgcaaccccagcacggcaacttgtttgtgaaccacaccttaaggtaacactgagactggtacttggtttctggagacaggctaaggatgcccttcaggtaccccgaggtaacacgagacactcgggatctgagaaggggaccgggagttctatcaaactgcccgatttaaaaagcttctatgcctgaataggtgaccggaggccggcaccttttctttattttaaaccacttt

SEQ ID NO: 822 - DNA, 685 bp, Didelphis aurita hepatitis A virus
  complete genome.1
cttttggagttctttggtctggggaactaaaataccagacccgcgtttgcctagcgatataggctttaattgttgtttgtcattgtgcgtttgatatgtgttttaatgtaaataataattctagcaggttctagttcttgatcatgtcctctttaaggcactcatttcaacttgctatctttcttttcttccttggttctccctacaccaaatgcactggccgctgcgcccggcggggtcaaccacatgattagcatgtggctgtaggtgttgaaggctgggacatgaacatcaatggaatagtgcgcatgcttactggggtccattgaagtagtgggatctttctattggggtaggctacgggtgaaaccccttaggttaatactcatattgagagataccttggataggttaactgtgctggatatggttgagtttaacgacaaaaagccatcaacagctgtggacagaacctcatccttagattgctcactatggatatgtgctctgggcgtgtttcttgcatgatggccattggtcaattcatgcctgggccaatgtaggattagccttaaattactttttaaaagtagcctcatttagctggactaatggtggggcgtatgatcctgcatttggcctctggggtaatcaggggcatttaggtttccacataatagcaaat

SEQ ID NO: 823 - DNA, 686 bp, Human enterovirus
  113, isolate BBD-83 polyprotein gene, complete1
caccccagaggcccacgtggcggccagtactctggtatcacggtacctttgtacgcctgttttatatcccttccccatgtaactttagaagcaattcacatagttcaatagagggggtacaaaccagtgccaccacgaacaagcacttctgtttccccggtgaagctgtatagactgtccccacggtcaaaaacggcagatccgttatccgctcatgtacttcgagaagcctagtagcatcttggaatcttcgatgcgttgcgttcagcactctaccccgagtgtagcttaggtcgatgagtctgggcataccccaccggcgacggtggcccaggctgcgttggcggcctacccatggctaacgccatgggacgctagttgtgaacaaggtgtgaagagcctattgagctacatgagagtcctccggcccctgaatgcggctaatcctaaccacggagcaagtactcacaacccagtgagcagcttgtcgtaacgcgtaagtctgtggcggaaccgactactttgggtgtccgtgtttccttttatttttgatatggctgcttatggtgacaatcaaagattgttatcatatagcttttggattggccatccggtgatttttgagactataacgtttacttgccttaccacacaacttagtactttgctacattcacacagtcata

SEQ ID NO: 824 - DNA, 687 bp, Echovirus
  E14, isolate ETH_P19/E14_2016 polyprotein gene, complete1
tggtatcacggtacctttgtgcgcctgttttatctacccctccccaatgtaatttagaagcatatgaaaagcggtcaatagccggctcagtatgccaactgagtcttgaccaagcacttctgttaccccggactgagtatcaataagctgctcgcgcggctgaaggagaaaacgttcgttacccggccaattacttcgagaaacccagtaccaccatggaggttgcgcggcgtttcgctccacacaaccccagtgtagatcaggtcgatgagtcaccgcgttccccacgggcgaccgtggcggtggctgcgttggcggcctgcccatgggttagcccatgggacgcttcaatactgacatggtgcgaagagtctattgagctaattggtagccctccggcccctgaatgcggctaatcctaactgcggagcagacgcctacatgccagtgggtagtctgtcgtaacgggcaactctgcagcggaaccgactactttgggtgtccgtgtttccttttatctttgtattggctgcttatggtgacaattgaaagattgttaccatatagctattggattggccatccagtgacaaacagagcgattgtttactcatttataggttttgtaccacttgactacaaggccctaatcactctcaattatatattgatactaaatacgacaaa

SEQ ID NO: 825 - DNA, 687 bp, Enterovirus B
  complete genome.1
tggtatcacggtacctttgtgcgcctgttttatttaccctctccccagtgtaacttagaagcacgcttcatgcggtcaataggcggctcagtataccaactgagtctcgaccaagcacttctgttaccccggaccgagtatcaataagctactcacgtggctgaaggagaaaacgtccgttacccggccaactacttcgagaaacctagtaccaccatgaatgttgcgcggcgtttcgctccgcacaaccccagtgtagatcaggtcgatgagtcaccgcatccctcacgggcaaccgtggcggtggctgcgctggcggcctgcctatggggcaacccataggacgcttcaatacggacatggtgagaagagtctattgagctagttggtagtcctccggcccctgaatgcggctaatcctaactgcagagcagattcccacacgccagtgggtagtctgtcgtaacgggcaactctgcagcggaaccgactactttgggtgtccgtgtttccttttattcttgtactggctgcttatggtgacaattgaaagattgttaccatatagctattggattagccacccagtgtctaatagagcaattatttatctttttgttggatttatcccacttgactataaagcacttgtaacgctcaagtatattatagatctcaacacaacaa

SEQ ID NO: 826 - DNA, 689 bp, Human enterovirus sp.
  C116 polyprotein gene, complete cds.1
ttcccactccagaggcccacgtggcggctagtactctggtattgcggtacctttgtacgcctgttttataccccctccccaagtaactttagaagcaattcacaaagttcaatagagggggtacaaaccagtaccaccacgaacaagcacttctgtttccccggtgaagctacatagactgtccccacggtcgaaggtggcagatccgttatccgctcaagtacttcgagaagcctagtaccaccttggaatcttcgatgcgttgcgctcagcactctaccccgagtgtagcttaggtcgatgagtctgggcatgccccaccggtgacggtggcccaggctgcgttggcggcctacccgtggctaacgccatgggacgctagttgtgaacaaggtgtgaagagcctattgagctacttgagagtcctccggcccctgaatgcggctaatcctaaccacggagcaagtgctcacaaaccagtgagtggcttgtcgtaacgcgtaagtctgtggcggaaccgactactttgggtgtccgtgtttccttttattttcattatggctgcttatggtgacaatctaagattgttatcatatagcttttggattggccatccggtgatttgaaagagatatatttaccttattgttctaccatatctaattactcatcacagccacataatcaca

SEQ ID NO: 827 - DNA, 689 bp, Human enterovirus
  isolate EV/Human/CMRHP45/CMR/2014 polyprotein1
gacagttgggtagcattgtgcgcctgttttatacaccctttcccacaatgcaacttagaattataactaaaccggccaatagaaagctcggcaaaccagccgagttctggtcaagcacttctgttgccccggactgagtatcaataagctgctcgcgcggctgaaggagaaaacgttcgttacccgaccaactacttcgagaaacccagtatcaccatgaaagctgcgtagcgtttcgttccgcacaaccccagtgtagatcaggccgatgagtcaccgcaatccccacgggcgaccgtggcggtggctgcgctggcggcctgcccatggggcgacccatgggacgcttcaataccgacatggtgtgaagagtctattgagctagttggtagtcctccggcccctgaatgcggctaatcccaactgcggagcagacgcttgcataccagcaagtagtctgtcgtaacgggcaactctgcagcggaaccgactactttgggtgtccgtgtttccttttattttttatactggctgcttatggtgacaattgaaagattgttgccatatagctattggattggccatccggtgacgaacagagctatcatatactcttttgttgggtttgtcccattgaactacaaggcattgaataccctcaatttcattctagcactaaatacaataaa

SEQ ID NO: 828 - DNA, 691 bp, Human cosavirus
  isolate Cosavirus-zj-1, complete genome.1
tggaatactgcaaagatgtcaccgtgctatacacggtctttgaaccacacaccggctacttggcacttgcagcgcagtaagtttattttccacttatccttgatttttagccgtacagtttctctctgcatgggcggcgtgatactcccgttccttcttggacagattgcctccgcgttctctgtggatctcaaggtggtcaagtcactggtgagtagagcgaaggttaaggagatctgaggcattcccacgtggcgttgccgggagttgtagcaatgctgcgtgtgtgtacggatctcgcctcatggcgtcatgagcctcacacgccaaaagctctgtccgagaggacctacacagtcgagcaaccctagctccttcctacaaagccttgtgtgaatgagctcacgtttactcaactttattctctactcacatcaggcgccaaagatgtcttgaaggtacctcgtgtatctgggcacgagcaccatcgactacccggacttgcacttcggtgcagacacatgtggtgtcccagcccccttgctccggcaagggggctctgctcgctcagcacgagatctgatcaggagtctcccccggtgtaaagcaccttgacagggatttaaaaattgaccaaggccttgcacacaacctaggggactaggttttcctttttatttacaaggttttc

SEQ ID NO: 829 - DNA, 693 bp, Coxsackievirus
  A12, isolate 283 polyprotein gene, complete cds.1
gttgtacccactcacagggcccactgggcgttagcactctggtaccccggtacctttgtgcgcctgttttatatccccccaagtaatgcacctcgatcaatagcgggcgtggcgcaccagccacgtcatgatcaagcacttctgtttccccggaccgagtatcaatagactgctaacgcggttgagggagaaaacgtccgttacccggccaactgcttcgagaaatccagtaacatcatgaaaattgcagagtgtttcgctcagcacttccccagtgtagatcaggtcgatgagtcaccgcgttccccacgggcgaccgtggcggtggctgcgttggcggcctgcctgtggggcaacccgcaggacgctctaatatggacatggtgtgaagaatctattgagccagttggtagtcctccggcccctgaatgcggctaatcctaactgcggagcacgcgccttcaatccagtgggtagcgtgtcgtaatgggtaactctgcagcggaaccgactactttgggtgtccgtgtttccatttattcttacattggctgcttatggtgacccatatagctattggattggccatccggtatcgaatagagcgattatctatcagtttgttggatttattccgttgagtgtgcagcagtatcgcactttgcttttaatagtgagactgaatagtgcaaa

SEQ ID NO: 830 - DNA, 693 bp, Coxsackievirus
  A2 clone V18A polyprotein gene, partial cds.1
ctgattctgcggaatctttgtgcgcctgttttatactccctcccccaacacagtaacttagaagtcataaactcacatgaccaatagtgggcatgacgcaccagtcatgtctcggtcaagcacttctgtctccccggactgagtatcaataagctacttgcgtggctgaaggagaaaacgttcgttatccggctaactacttcgagaagcttagtagcaccatgaaagttgcggagtgtttcgctcagcacttcccccgtgtagatcaggtcgatgagtcactgcgttcctcacgggagaccgtggcagtggctgcgttggcggcctgcctatggggcaacccataggacgctctaatatggacatggtgtgaagagcctattgagctagttagtggtcctccggcccctgaatgcggctaatcctaactgcggagcacataccctcaacccagggggcagtgtgtcgtaacgggcaactctgcagcggaaccgactactttgggagtccgtgtttccttttattcttatattggctgcttatggtgacaattgagagattgttaccatatagctactggattggccacccggtgtctaatagagccctggtttaccaatttattggatttgtgcctttatcacccacagtttattcaaccttagtatttttgatatatcttaacaataggcg

SEQ ID NO: 831 - DNA, 693 bp, Coxsackievirus
  A20, isolate ETH_P16/A20_2016 polyprotein gene,1
tacgttatcgcggtacccttgtacgcctgttttatactcccttcacccgtaacttagaagcaagcaaaccaagttcaatagaagggggtacaaaccagtaccaccacgaacaagcacttctgtttccccggtgaggttgcatagactgtacccacggtcaaaagcgattgatccgttatccgctctagtacttcgagaagcctagtatcaccttgggatcttcgatgcgttgcgctctgcactcgaccccggagtgtagcttaggtcgatgagtctggacacccctcaccggtgacggtggtccaggctgcgttggcggcctacctgtggcccaaagccacaggacgctagttgtgaacaaggtgtgaagagcctattgagctaccagagagtcctccggcccctgaatgcggctaatcccaaccacggagcaagtgctctcaaaccagagagtggcttgtcgtaacgcgcaagtctgtggcggaaccgactactttgggtgaccgtgtttccttttatttttatcatggctgcttatggtgacaatctcagattgttatcataaagcaaattggattagccatccggtgaaagtcaaatcgattatttacttatttattggtttttctccactaacaccacaaacacttaaaattattgaaatagtgctgctaattagataccactatcata

SEQ ID NO: 832 - DNA, 694 bp, Human rhinovirus A
  strain HRV-A82_p1126_sR1024_2009 polyprotein1
cgtcgaccggggagacagaagtgcttgaccttatacagctggtatgctgcttgctattggtctgtgtgcaaaacttctaagttaaaattgggtctgggttgctcccacccagatcacccacgtggtgttgtgctctgttattccggtaactttgcacgccaattttataaccccttcccccatgtaacttagaagttttgcacacagaccaatagcaagcagcataccagctgtataaggtcaagcacttctgtctccccggtcgacgttgatatgcttcaacaaggcaaaaacaacagagatcgttatccgcaagatgcctacacaaagcctagtacctcctttgacggtgtttgtctggtcgctcaggtgcttccccagcactagacctggcagatgaggctagaaactccccactggcgacagtgttctagcctgcgtggctgcctgcacacccttctgggtgtgaagccaaatactagacaaggtgtgaagagccccgtgtgctcatcttgagtcctccggcccctgaatgcggctaaccttaaacccgcagccattgctcacaatccagtgggtagatggtcgtaatgagcaattgtgggatgggaccgactactttgggtgtccgtgtttcatgttttactttatgatttgcttatggtgacaatatatagtgatatatattggcatc

SEQ ID NO: 833 - DNA, 694 bp, Coxsackievirus
  A13 clone V7B polyprotein gene, partial cds.1
tccggtattacggtacccttgtacgcctgttttatactcccctcccccgtaacttagaaaacttcaaaatcaaagttcaataggagggggtacaaaccagtaccaccacgaacaagcacttctgtttccccggtgatgttgtatagactgtctccacggttgaaaacgactgatccgttatccgctctagtacttcgagaagcccagtaccaccttggaatcttcgatgcgttgcgctcagcactcaatcccagagtgtagcttaggttgatgagtctggacatccctcaccggcgacggtggtccaggctgcgttggcggcctacctgtggcccaaagccacaggacgctagttgtgaacaaggtgcgaagagcctattgagctactagagattcctccggcccctgaatgcggctaatcccaaccacggagcaggtactcacaacccagtgagcagcctgtcgtaacgcgcaagtctgtggcggaaccgactactttgggtgtccgtgtttccttttatttttatatggctgcttatggtgacaatcattgattgttatcataaagcgaattggattggccatccggtgaaagttagacttatcatttacttgtttgttggattcactcctttgactaaattcacccctgacatcatcttagttgtgatactgattaggagacttcatcata

SEQ ID NO: 834 - DNA, 695 bp, Enterovirus sp.
  A71 gene for polyprotein, complete cds, isolate: 10857.1
tctgattctgcggaatccttgtgcgcctgttttatatcccctttcccaatttgaaacatagaagtgatgcgcaccattgatcaatagtaggcgtaacgcgccagttacgtctcgatcaagcacatctgtttccccggaccgagtatcaatagactgctcacgcggttgaaggagaaagcgttcgttacccggctaactacttcgagaaacccagtagcaccatggaagctgcagggtgtttcgctcagcacttcccccgtgtagatcaggtcgatgagccactgcaatccccacgggcgaccgtggcagtggctgcgttggcggcctgcctatggggagacccataggacgctctaatgtggacatggtgcgaagagtctattgagctagttagtagtcctccggcccctgaatgcggctaatcctaactgcggagcacatgccttcaacccagaaggtggtgtgtcgtaacgggcaactctgcagcggaaccgactactttgggtgtccgtgtttcctttcattcttatatcggctgcttatggtgacaattacggaattgttaccatatagctattggattggccatccggtgtgtaatagagctattatatatctgtttgttggctttgtgccattaactttaaagtctacaactactcttgattttatattgaccctcaacacagttaaac

SEQ ID NO: 835 - DNA, 696 bp, Encephalomyocarditis virus
  EMCV-30 polyprotein gene, complete cds.1
ttgccagtctgctcgatatcgcaggctgggtccgtgactacccactccccctttcaacgtgaaggctacgatagtgccagggcgggtactgccgtaagtgccaccccaaacaacaacaacaaaacaaactccccctccccccccttactatactggccgaagccacttggaataaggccggtgtgcgtttgtctacatgctattttctaccgcattaccgtcttatggtaatgtgagggtccagaacctgaccctgtcttcttgacgaacactcctaggggtctttcccctctcgacaaaggagtgtaaggtctgttgaatgtcgtgaaggaagcagttcctctggaagcttcttaaagacaaacaacgtctgtagcgaccctttgcaggcagcggaaccccccacctggtgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacgtgctttacacgtgttgagtcgaggtgaaaaaacgtctaggccccccgaaccacggggacgtggttttcctttgaaaaccacgattacaat

SEQ ID NO: 836 - DNA, 697 bp, Echovirus
  E2, strain USA/2013-19511, complete genome.1
ctagcactccggtattgcggtacccttgtgcgcctgttttatcctccctccccctaacgtaatttagaagcaagactttaacggtcattaggtggctcagcacaccagccgagtcaagaccaagcacttctgttaccccggactgagtatcaataagctgctcacgtggctgaaagagaaaacgttcgttacccggccaattacttcgagaaacctagtaccaccatggaggttgcgcagcgtttcgctccgcactaccccagtgtagatcaggtcgatgagtcaccgcattccccacgggcgaccgtggcggtggctgcgttggcggcctgcccatggggaaacctatgggacgcttcaatactgacatggtgtgaagagtctattgagctaattggtaatcctccggcccctgaatgcggctaatcctaactgcggagcagacacccacaagccagtgagcagtctgtcgtaacgggcaactctgcagcggaaccgactactttgggtgtccgtgtttccttttattccattactggctgcttatggtgacaattgagagattgttaccatatagctattggattggccatccggtgagcaacagagcacttatatatctctttgttggattcataccactagacaccaggagttttacgtctttggtttatattttaaggttgaacacagcaaa

SEQ ID NO: 837 - DNA, 697 bp, Human rhinovirus A
  strain HRV-A38_p1266_s3799_1999 polyprotein1
aacagaagtgcttgaccattgacaatttggttaattgccgcctattggtcgttatgtactttcttctaagttacaaggggggggtgttaaaactggatctgggttgttcccactcaggtctcccacgtggagttgtactctattattccggtaatcttgtacgccagtttttacacccccccccttgtaacttagaagaaagtacataacgaccaataggcggcaattaaccaaattgtcaatggtcaagcacttctgtttccccggtcaagattgatacgctccaacagggcgaaaacaatcgagatcgttatccgcaaagtgcctacgcaaagcttagtaacattttggaaagtttatggttggtcgctcagctaaaccccatagtagacctggcagatgaggctagagactccccactggcgacagtgttctagcctgcgtggctgcctgcacaccctcacgggtgtgaagccatatactcgacaaggtgcgaagagccccgtgtgctcactttgagtcctccggcccctgaatgtggctaaccttaaccccgcagctagcgcatgcaaaccagtatgtagctagtcgtaatgagcaattgtgggatgggaccaactactttgggtgtccgtgtttcactttttaccttttatttgcttatggtgacaatatatatatagtatatattgacacc

SEQ ID NO: 838 - DNA, 697 bp, Human rhinovirus A
  strain HRV-A19_p1294_s6535_2000 polyprotein1
ggcaccttgcggataacgatcgctgttgtttttgccctgttggagcatatcaacattgaccggggaaacagaagtgcttgacctattaaaactggatctgggttgttcccacccagatcatccacgtgatgttgtgctctattattccggtaattttgcacgccagtttttcatccctttccctttgtaacttagaagattgaacaaatgaccaataggacgcaacaaaccagttgtaataggtcaagcacttctgtttccccggtcaatgttgatatgctccaacagggcaaaaacaacagcgatcgttatccgcaaggtgcctacgcaaagcctagtagcactcttgaaattgcttggttggtcgctcaggtgcaaacccagcactagacctggcagatgaggctagaaaatccccactggtgacagtgttctagcctgcgtggctgcctgcacacccatttgggtgtgaagccaaacaatggacagggtgtgaagagccccgtgtgctcatcttgattcctccggcccctgaatgcggctaaccttaaacctgcagccattactcacaatccagtgagttggtggtcgtaatgagtaattgcgggatgggaccgactactttgggtgtccgtgtttcactttttaccttattttatgcttatggtgacaatatattgtaatatatattgacacc

SEQ ID NO: 839 - DNA, 698 bp, Simian enterovirus SV43
  strain OM112t (P12), complete genome.1
ttaaaacagcctgtgggttgttcccacccacagggcccactgggcgctagtactctggtattacggtacctttgtacgcctgttttacaacccttcccccatgtaacttagaagcaacaaataaacgaccaatagcacactcaccaatccagatgagtgatggtcaagcacttctgttaccccgggcttagtaccaatagactgccatcgcggttgaaggggaaaacgctcgttatccggctctctactgcgagaagcctagtaacgccttagaaatgctcaagcgttgcgctcagcacaaccccagtgtagctcaggtcgatgagtcactgcattccccacgggcgaccgtggcagtggctgcgtttgcggcctgcctacagctctacgctgtaggacgcttgtgtatggacatggtgtgaagagcccattgcgctagggagtagtcctccggcccctgaatgcggctaatcctaaccccggagctggtgcttgtaaaccaacaagtggccagtcgtaatgggcaactctgggatggaaccgactactttgggtgtccgtgtttcctgttttatttaccttggctgcttatggtgacaatctagtgttgttgccatatagcgattggattggccatccggatattgttttagacacttgtgtttgtgagtagatctcttctgacataggatataaca

SEQ ID NO: 840 - DNA, 698 bp, Enterovirus sp.
  D68, isolate CF569939-FRA-2018, complete genome.1
ttaaaacagccttggggttgttcccactccaagggcccatgtggcggctagtactctggtacttcggtacctttgtacgcctgttttatctcccttcccaatgtaatttagaagctcttaaatcaaggctcaataggcggggcgcaacccagcgctctcatgagcaagcacttctgtctccccggtgtggttgtataaactgttcccacggttgaaaacaacctatccgttatccgctatagtacttcgagaaacctagtatcacctttggattgttgacgcgttgcgctcagcacactaacccgtgtgtagcttgggtcgatgagtctggacataccccactggcgacagtggtccaggctgcgttggcggcctactcatggtgaaaaccatgagacgctaaacatgaacaaggtgtgaagagtctattgagctactatagagtcctccggcccctgaatgcggctaatcctaaccatggagcaagcgctcacaagccagtgagttgcttgtcgtaatgcgcaagtccgtggcggaaccgactactttgggtgtccgtgtttcactttttacttttatgactgcttatggtgacaatttgatattgttaccatttagcttgtcaaattaattacaaaaggttctaaatcttacttaccaacctgcattttgataaccttgatttgaaaattttaata

SEQ ID NO: 841 - DNA, 699 bp, Enterovirus J
  strain 1631, complete genome.1
ttaaaatagcctcagggttgttcccaccctgagggcccacgtggcgtagtactctggtatcaaggtacctttgtacgcctattttatttcccttcccccacagtaacttagaagcttatctcatagttcaacagtagggtcactaaccaagtggctcagcgaacaagcacttctgtttccccggtcctagtacctgtgaagctgtacccacggcggaaggggaaaaagatcgttatccggccccctacttcggaaagcctagtaacaccattgaagcaatcgagtgttgcgctcagcacagtaacccctgtgtagctttggttgatgagtctgggcactccccactggcgacagcggcccaggctgcgttggcggccaaccgactcgggcaaccgggtcggacgctcgtttgtggacatggtgtgaagagcctactgagctagagggtagtcctccggcccctgaatgcggataatcctaaccccggagcacccacactcaatccagagtgcaggatgtcgtaacgcgtaagtctgggacggaaccgactactttgggtgtccgtgtttcctgttttacttactttggctgcttatggtgacaatctagtgttgttaccatatagctattggattggccatccggtgttttgaattgtgtgtttatactaattcttttacatatcacagacaaccaaat

SEQ ID NO: 842 - DNA, 699 bp, Enterovirus C
  strain 04-1450, complete genome.1
tagtactccggtatcgcggtacccttgtacgcctgttttatactcccttcccccgtaacttagaagcaatcaaaccaagttcaatagaagggggtacaaaccagtaccaccacgaacaagcacttctgtttccccggtgaggttgcatagactgtacccacggttgaaagcgactaatccgttatccgctcaagtacttcgggaagcctagtaccaccttcggatcttcgatgcgttgcgctcagcactcaaccccagagtgtagcttaggctgatgagtctggacattcctcactggcgacagtggtccaggctgcgttggcggcctacctgtggcccaaagccacaggacgctagttgtgaacaaggtgtgaagagcctactgagctacttgagattcctccggcccctgaatgcggctaatcccaaccacggagcaggtggtcataaaccaatggctggcctgtcgtaatgcgcaagtctgtggcggaaccgactactttgggtgtccgtgtttccttttatcttttcattggctgcttatggtgacaatcatagattgttatcataaagcaaattggattggccatccggtgaaaatcagagcgattatatatttgtttactggatttacatcactgacaccatactctccaatactcattaggttggttttattaataaggtattattaccata

SEQ ID NO: 843 - DNA, 700 bp, Simian enterovirus SV19
  strain M19s (P2), complete genome.1
ttaaaacagcctgtgggttgtacccacccgcagggcccactgggcgctagtacactgatatcacggtacctttgtacgcctgttttatctccctacccccatcgtaacttagaagcttaacaatacagatcaatagcctctgcaccaaaccaggtgtggaatgatcaagcatttctgttaccccggacctagtaccaataggctgtgtcaaacggctgaaggggaaaaagttcgttacccggccacctacttcgagaagcctagtagcatcactgaagctgtgaagcgttacgatcagcacaaccccagtgtagttcaggtcgatgagtcactgcattccccacaggcgactgtagcagtggctgcgttggcggcctgcccttggtctctgaccaagggacgctttggagtggatatggtgcgaagagcctattgagctaggtggtagtcctccggcccctgaatgcggctaatcctaaccccggagctggtgcacacaaaccagtgtgtggccagtcgtaatgagcaattctgggatggaaccgactactttgggtgtccgtgtttcctgtttcacttaccttggctgcttatggtgacaattgtatagttgtcatcatatagctattggattggccatccggatattattcttgtgtttatttgtgtaatttgatataatttagaaccctgtataaga

SEQ ID NO: 844 - DNA, 702 bp, Coxsackievirus
  A16, isolate CVA16/Shenzhen189/CHN/2017, complete1
gcgttagcacactgattctacggaatctttgtgcgcctgttttataaccccttccccaagcagcaacttagaagcttcgcgccaccacgaccagtagtgggcgtgacacaccagtcacgttttggtcaagcacttctgtttccccggactgagtatcaatagactgctcacgcggttgaaggagaaaacgttcgttatccggccaactacttcgagaaacctagtagcatcgtggaagttgcggagtgtttcgctcagcacttcccccgtgtagatcaggtcgatgagtcactgtaaaccccacgggcgaccgtgacagtggctgcgttggcggcctgcccatggggcaacccatgggacgctctaatacagacacggtgtgaagagtctattgagctagttggtagtcctccggcccctgaatgcggctaatcctaactgcggagcgcgcaccctcaacccagggggcagtgcgtcgtaacgggtaactctgcagcggaaccgactactttgggtgtccgtgtttccttttattctctattggctgcttatggtgacaattgaaaagttgttaccatatagctattggattagccatccggtgaccaacagagctattatttacctgtttgttgggtatatccctctcactctcaaggccattcaaactcttaactatatattactccttaactgtaagag

SEQ ID NO: 845 - DNA, 704 bp, Mengo virus
  strain 3761IMP, complete genome.1
tgtgctcttccgatctgggagatccagattgccagtctgctcgatatcgcaggctgggtctgtgactacccactccctctttcaacgtgaaggctacgatagtgccagggcgggtactgccgaaagtgccaccccaaagtacacaaccccccccgtacattactggccgaagccgcttggaataaggccggtgtgtgtctgtctacatgttatttctactacattgtcgtctatggcaatgtaagggcccggaacctggccctgtcttcttgacgaatattcctaggggtctttcccctctcgacaaaggaatataaggtctgttgaatgtcgtgaaggaagcagttcctctggaggcttcttgaagacaaacagtgtctgtagcgaccctttgcaggcagcggaaacccccacctggtaacaggtgcctctgcggccaaaagccacgtgtataagatacacctgcaaaggcggcacaaccccagtgccacactgtgcgttggatagttgcggaaagagccaaatggctctccttaagcgtattcaacaaggggctgaaggatgcccagaaggtaccccactagttgggatctgatctggggcctcggtgcacgtgctctacacgtgttgagtcgaggttaaaaaacgtctaggccccccgaaccacggggacgtggttttcctttgaaaaccacgatgacaat

SEQ ID NO: 846 - DNA, 704 bp, Human poliovirus 2
  strain CHA1219346, complete genome.1
tagtactccggtatcacggtacccttgtacgcctgttttaaactcccttccctcgtaacttagaagcaaacaaaccaagttcaatagaaaggggtacaaaccagtaccaccacgaacaagcacttctgttgccccggtgatgtcgtatagattgtacccacggtcgaaaacgattgatccgttatccgcttttgtacttcgagaagcctagtaccaccttggaatcttcgatgcgttgcgctcggcactcaatcccagagtgtagcttaggtcgatgagtctggacataccccaccggtgacggtggtccaggctgcgttggcggcctacctgtggcccaaagccacaggacgctagttgtgaacaaggtgtgaagagcatattgagctacaaaagagtcctccggcccctgaatgcggctaatcctaaccacggagcaagggtgcacaaaccagtgtataccttgtcgtaacgcgtaagtctgtggcggaaccgactactttgggtgtccgtgtttcctgttattttttatcatggctgcttatggtgacaatcagagattgttatcataaagcaaattggattggccatccggtgagtgttgtgtcaagtatacaactgtttgttggaaccactgtgttagcttcacttctcatttaaccaattaatcaaaaacaatacgaggataaaacaataatactaca

SEQ ID NO: 847 - DNA, 704 bp, Echovirus
  E7, strain Nigeria/AFP/2014, complete genome.1
atgggcgctagcacactggtatcccggtacctttgtgcgcctgttttatctacccctccccaaacgtaacttagaagcacatcacacatggtcaacaggtggcacagtacaccaactgggccgtgaccaagcacttctgttaccccggaccgagtatcaatagactgctcgcgcggttgaaggagaaaacgttcgttacccggccaattacttcgagaaacccagtaccaccgtgaaggttgcgcagcgtttcgctccgcacaaccccagtgtagatcaggtcgatgagccaccgcattccccacgggtgaccgtggcggtggctgcgttggcggcctgcccatggggcaacccatgggacgcttcaatactgacacggtgcgaagagtctattgagctaattggtattcctccggcccctgaatgcggctaatcctaactgcggagcagatacccacaagccagtgggcagtctgtcgtaacgggtaactctgcagcggaaccgactactttgggtgaccgtgtttccttttattcttatattggctgcttatggtgacaattgaaagattgttgccatatagctattggattggccacccagtgacaaacagagctattgtttacctatttgttggctttataccactgaatcttaaagttttagaaactctcaacctgatcttattactcaattcggtaaa

SEQ ID NO: 848 - DNA, 705 bp, Echovirus
  E9, strain 61253-70985 polyprotein gene, complete cds.1
cacggggcgcaagcacactggtattacggtacctttgtgcgcctgttttacccacccttccccaatgaaatttagaagcttgacttaaacggtcagtagacaacccagtatgccaactgggtcccgaccaagcacttctgtctccccggactgagtatcaataggctgcttgcgcggctgaaggagaaaacgttcgttacccgaccaactacttcgagaaacctagtaccaccatgaacgttgcgcagcgtttcgctccacacaaccccggtgtagatcaggtcgatgagtcaccgcaatccccacgggcgaccgtggcggtggctgcgctggcggcctgcccatggggcaacccatgggacgcttcaacactgacatggtgcgaagagtctattgagctagttggtagtcctccggcccctgaatgcggctaatcctaactgcggggcagatacccacataccagtgggcagtctgtcgtaacgggcaactctgcagcggaaccgactactttgggtgtccgtgtttccttttatccttatattggctgcttatggtgacaattgaaagattgttaccatatagctattggattggccatccagtgagcaacagagcgatcatactcctctttgttgggtttataccacttgactacagcagttacaacaccttgttgtacatcgtttatttgaatacgagaaa

SEQ ID NO: 849 - DNA, 707 bp, Enterovirus C
  strain 04-4491, complete genome.1
aggctagtacaccgggtaccgtgataccggtgtactagcctgttttatactcccttcccccgtaacttagaagtaaataacacaagttcaatagaagggggtacaaaccagtaccaccacgaacaagcacttctgttcccccggtgaggtcacatagactgtctccacggttgaaagtgactgatccgttatccgctcttgtacttcgggaagcctagtagcatcttcggatcttcgatgcgttgcgctcagcactcaatcccagagtgtagcttaggtcgatgagtctggacatccctcactggcgacagtggtccaggctgcgttggcggcctacctgtggcccaaagccacaggacgctagttgtgaacaaggtgtgaagagcctactgagctacttgagagtcctccggcccctgaatgcggctaatcccaaccacggagcaaatgactgcaatccagcagttagtttgtcgtaatgcgtaagtctgtggcggaaccgactactttgggtgtccgtgtttccttttatattttatattggctgcttatggtgacaatcactgattgttatcataaagcgacttggattggccatccggtgaaaataagagttattatctacttatttgttggatttactccactatcaacctacacaccagagctcatacgcattgttatagtactaagaaatatacatcaca

SEQ ID NO: 850 - DNA, 707 bp, Coxsackievirus
  A19, strain BBD66 polyprotein gene, complete cds.1
taaaacagctctggggttgttcccaccccagaggccacgtggcggccagtactctggtatcaaggtacctttgtacgcctgttttatatcccctcccccaagtaactttagaagcaattcaaacagttcaatagagggggtacaaaccagtaccaccacgaacaagcacttctgtttccccggtgaggctgtatagactgttcccacggttgaaaatggctgatccgttatccgctcatgtacttcgagaagcctagtatctccttggaatcttcgatgcgttgcgctcagcactctaccccgagtgtagcttaggctgatgagtctgggcataccccaccggtgacggtggcccaggctgcgttggcggcctacccatggctaacgccatgggacgctagttgtgaacaaggtgtgaagagcctattgagctacttgagagtcctccggcccctgaatgcggctaatcccaaccacggagcaagtgcctgcataccagcaggtagcttgtcgtaacgcgcaagtctgtggcggaaccgactactttgggtgtccgtgtttccttttattcttatcatggctgcttatggtgacaatctaagattgttatcatatagcttttggattggccatccggtgattgtttgatatttgaacacttgtttaccttatcttattacacaccaatttacatacctaacttcatt

SEQ ID NO: 851 - DNA, 708 bp, Coxsackievirus
  B5 polyprotein gene for polyprotein, VP4 and VP2 and1
cccactgggcgctagcacactggtattacggtacctttgtgcgcctgttttatctaccctccccccaacgcaacttagaagcataacttaaatggtcaacagataactcagtatgccaactgagccctgaccaagcacttctgttatcccggactgagtaccaataggctgctcacgcggccgaaggggaaaccgttcgttacccggccaattacttcgagaaacctagtaccaccatgaaagttgcgcagtgtttcgctccgcacaaccccagtgtagatcaggtcgatgagtcaccgcaaaccccacgggcgaccgtggcggtggctgcgttggcggcctgcccatggggcaacccatgggacgcttcaatactgacatggtgcgaagagtctattgagctaattggtagtcctccggcccctgaatgcggctaatcccaactgcggagcagatacccacacaccagcgggcagtctgtcgtaatgggcaactctgcagcggaaccgactactttgggtgtccgtgtttccttttattctcatactggctgcttatggtgacaattgagagattgttaccatatagctattggattggccatccggttacaaacagagcaattatttacttatttgttggttttgtaccactgaactacagagtcctgaaaaccctcaatctcattataacactcaatacgttaaa

SEQ ID NO: 852 - DNA, 708 bp, Enterovirus sp.
  B69 isolate 15_491 polyprotein gene, complete cds.1
gcccactgggcgttagcactctggtattaaggtacctttgtgcgcctgttttataatcccttcccaacttgcaacttagaagtaacacactatgaccaatagggggcgtggcaaaccagccatgccttggtcaagcacttctgtttccccggactgagtatcaataagctgtccacacggctgaaggagaaaacgtccgttacccggccagttacttcgagaaacctagtaccaccatgaaagttgcgtagcgtttcgctccgcacatccccagtgtagatcaggtcgatgagtcaccgcaatccccacgggcgaccgtggcggtggctgcgctggcggcctgcccatggggcaacccatgggacgctacaatactgacatggtgtgaagagtctattgagctaactggtagtcctccggcccctgaatgcggctaatcctaactgcggagcagatacccacacgccagtgggcagtctgtcgtaacgggcaactctgcagcggaaccgactactttgggtgtccgtgtttccttttattcatattttggctgcttatggtgacaattgagagattgttaccatatagctattggattggccatccggtgacaaacagagctatcatctatcttttcatcggcttcgtaccgctgaaccacaaagtatttaacaccctcaatttagtattggccttcaatatagcaaa

SEQ ID NO: 853 - DNA, 708 bp, Enterovirus B
  isolate E0-150 polyprotein gene, partial cds.1
ccactgggcgttagcacactggtatcacggtacccttgtgcgcctgttttatatacccttccccgtagagtaacttagaagcttgactacgacggtcaataggaaacccagtgcaccaactggggcgcgaccaagcactcctgtaaccccggactgagtatcaataagctgcttgcgtggctgaaggagaaaacgttcgttacccggccaattacttcgagaaacctagtaccaccatgaaagttgcgcagcgtttcgctccgcacaaccccagtgtagatcaggccgatgagtcaccgcattccccacgggcgaccgtggcggtggctgcgttggcggcctgcccatgggataacccatgggacgcttcaatactgacatggtgcgaagagtctattgagctaattggtagtcctccggcccctgaatgcggctaatcctaactgcggagcagacacccacaagccagtgggcagtctgtcgtaacgggtaactctgcagcggaaccgactactttgggtgtccgtgtttccttttatttctatactggctgcttatggtgacaattgaaaggttgttaccatatagctattggattggccatccggtgtctaacagagcaatcatttatttatttgttggattcgtacccctaaatcctaaagtctttaacactctcaacttcatattacgattaaatacagcaag

SEQ ID NO: 854 - DNA, 709 bp, Coxsackievirus
  A9 polyprotein gene for polyprotein, VP4 and VP2 and1
gggcccactgggcgctagcactctggtattacggtacctttgtgcgcctgttttacgctccttcccccaagtgcaacttagaagccaaacaccacgaccaatagtaggcaaggcgcaccagccgtgtctcggtcaagcacttctgtctccccggactgagtatcaataaactgctcacgtggttgaaggagaaaacgttcgttacccggctaattacttcgagaagcctagtaacaccatggaggttgcgaggcgtttcactcagcacgcccccggtgtagttcaggtcgatgagtcaccgcgttccccacaggcgactgtggcggtggctgcgttggcggcctgcccatggggcaacccatgggacgcttcaatgtcgacatggtgtgaagagcctattgagctagttagcagtcctccggcccctgaatgcggctaatcctaactgcggagcacgcgcccccaacccagagggtagcgtgtcgtaacgggtaactctgcagcggaaccgactactttgggtgtccgtgtttctttttatcttttattggctgcttatggtgacaattgagagattgttaccatatagctattggattggccatccggtgacgaacagagctataatttaccaatttgtaggatttattccattaagtttgaaagccttaaagacccttagtttaatactattgctcaatagtgtaaa

SEQ ID NO: 855 - DNA, 709 bp, Echovirus
  5 polyprotein gene for polyprotein, VP4 and VP2 and VP31
ggcccactgggcgccagcacactggtatcacggtacccttgtgcgcctgttttatttacccccccccaacgtaacttagaagcacaacctaatcggtcaatagataactcagtacaccaactgagtccagaccaagcacttctgttaccccggaccgagtatcaataagctgctcgcgcggctgaaggagaaaaggttcgttacccgaccaattacttcgagaaacccagtaccaccatggaagttgcgcagtgtttcgctccgcacaaccccagtgtagatcaggtcgatgagtcaccgcgttccccacgggcgaccgtggtggtggctgcgttggcggcctgcccatgaggtaacccatgggacgcttcaatactgacatggtgcgaagagtctattgagctaattggtagtcctccggcccctgaatgcggctaatcctaactgcggagcagatacctacacgccagtaggcagtctgtcgtaatgggcaactctgcagcggaaccgactactttgggtgtccgtgtttccttttattcttacattggctgcttatggtgacaattgagagattgttaccatatagctattggattggccatccagtgacaaacagagcgatcatctacttgtttgttggttttataccactaaattacaaagtcttaaacacactcaatttcattctgtcacttaatacattgag

SEQ ID NO: 856 - DNA, 710 bp, Encephalomyocarditis virus
  strain pEC9, complete genome.1
ttgaaagccgggggtgggagatccggattgccagtctgctcgatatcgcaggctgggtccgtgactacccactccccctttcaacgtgaaggctacgatagtgccagggcgggtactgccgtaagtgccaccccaaaataacaacagaccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataat

SEQ ID NO: 857 - DNA, 710 bp, Unknown
  Description of Unknown: Human coxsackievirus A22, strain ban99-10427, complete genome.1 sequence
ttaaaacagctctggggttgttcccaccccagaggcccacgtggcggctagtactctggtattgcggtacctttgtacgcctgttttatacccccttccccagtaactttagaagcaattcattcagttcaatagagggggtacaaaccagtaccaccacgaacaagcacttctgtttccccggtgaagccgtatagactgtacccacggttgaaaatggcagatccgttatccgctcatgtacttcgagaagcctagtatcatcttggaatcttcgatgcgttgcgctcagcactctaccccgagtgtagcttaggctgatgagtctgggcataccccaccggcgacggtggcccaggctgcgttggcggcctacccatggctaacgccatgggacgctagatgtgaacaaggtgtgaagagcctattgagctacttgagagtcctccggcccctgaatgcggctaatcctaaccacggagcaagcgcttacaaaccagtaagtagcttgtcgtaacgcgcaagtctgtggcggaaccgactactttgggtgtccgtgtttccctttatttttattgtggctgcttatggtgacaatctaagattgttatcatatagctattggattggccatccggtgatttgtcgagtttcaaacgcttgtttatttctccacaacacttgcctactcaatacatttacaaaccata

SEQ ID NO: 858 - DNA, 710 bp, Enterovirus sp.
  D68, isolate 2016-R5080, complete genome.1
tttaaacgcttctaaggttgtttacattgggggaggggagataaaaaccgtatttctgggtcttcggtacctttgtacgcctgttttatctccctccccaatgtaacttagaagctttcaaatcaaagctcaataggtggagcgcaaaccagcgctttcgtgagcaagcactcctgtttccccggtgcggttgtatagactgttcccacggttgaaaacaacctatccgttatccgctatagtacttcgagaaacctagtatcacctttggattgttgatgcgttgcgctcaacacactaacccgtgtgtagcttgggtcgatgagtctggacataccccactggtaacagtggtccaggctgcgttggcggcctactcatggtgaaaaccatgagacgctagacatgaacaaggtgtgaagagtctattgagctactatagagtcctccggcccctgaatgcggctaatcttaaccatggagcaagtgctcacaaaccagtgagttgcttgtcgtaatgcgcaagtccgtggcggaaccgactactttgggtgtccgtgtttcactttttacttttatgactgcttatggtgacaatttaatattgttaccattcagctagtcgaaataatcgcataaaactttaaatcctatctaacaattcacatttggatagtttcattttgaggactttaaacctacttacaaag

SEQ ID NO: 859 - DNA, 711 bp, Rodent hepatovirus
  RMU101637Micarv2010 polyprotein gene, complete1
ttcaaagggtggtgggcggtttccccgccctcccctctttggatgcccatagtgcgggggtataaataccgcactccctttagctgttccgagggtatcggaacctatatgtttgttttctgtctgtctgtcagctttatgtgtgctcgtcccctttagggcactcatttcagcttgctttcattcttttcttccccggttctcaccttaccggaggcactggccgttgcgcccggcggggtcaacctagtgattagcactaggctgtaggtgtctaaagtggtgacattaagacttggtaactgatttcagcactgttaactgatgttggggatgacttgattgatcttctggaaggggtaggctacgggtgaaaccccttatcttaataccactatgtagagatagattcagtaggttaagggcagtggataaggttgagttcattttggacaataaaccttcaacactggtggacccaatctcactgaccagatgctttcttgactgatccttcagaggggtgattcttctgaataggttgccttgacactgatgcctgagacccattgggtcgggccttaaatcatggaactccactggactttcatggcctagcttctgccttagacagactctggggccccacgaccctctgggcccttcggggtactcaggggcatttaggtttttccacaattaaaagagtta

SEQ ID NO: 860 - DNA, 711 bp, Rodent hepatovirus
  KEF121Sigmas2012 polyprotein gene, complete cds.1
ttcaaagggtggctgggattttgtcccagcctccctttggagttccttggctctggggaactaaattaccaggcccgcgtttacctagcgcttaggttaaaacccccatcccttatttgtaaatattgatttctgcaggttcagagtttcttaatcatgttccctttaggacactcactccacttgctttcattcttgtttccgtggttctcccatcaccacaagcactgaccattgcgcccggtggggttaaccatatgattagcatatggctgtaggtgtttaagggtgggacaataatggaaggtcaaatagcaggcttgtttaacttccttttgtttcatctcatgtatctttctgaaggggtaggctacgggtgaaaccccttaggttaatactcatattgagagatacctgtggtaggttaattgccctggataaacttgagttgttagacaataaagtttcaacaggggtggacaagatctcaccaccagactggcatgttgtgggacatctgggaggcaagtttcttcctgtgatgttggcctttacatattgcctgggtgttaagaaggagcccttaaattcacttttctgtgagcctagcttccgctggacggactttgggggcagcatccttcttgatgcttctggggtactcaggggcatttaggtttttccacattataaatatatagatgaatagag

SEQ ID NO: 861 - DNA, 711 bp, Unknown
  Description of Unknown: Human coxsackievirus A22, strain USA75-10624, complete genome.1 sequence
ttaaaacagctctggggttgttcccaccccagaggcccacgtggcggctagtactctggtatcgaggtacctttgtacgcctgttttacaccccttcccctgtgcaactttagaagcaaatcacaaagttcaatagagggggtgcaaaccagcaccaccacgaacaagcacttctgtttccccggtgatgctgtatagactgttcccacggtcaaaaatggcagatccgttatccgcttgagtacttcgagaagcctagtaccaccttggaatcttcgatgtgttgcgctcagcactctaccccgagtgtagcttaggctgatgagtctgggcataccccaccggcgacggtggcccaggctgcgttggcggcctacccatggctaacgccatgggacgctagttgtgaacaaggtgtgaagagcctattgagctactcaagagtcctccggcccctgaatgcggctaatcctaaccacggagcaagtactcacaaaccagtgagcggcttgtcgtaacgcgtaagtctgtggcggaaccgactactttgggtgtccgtgtttccttttatttttattgtggctgcttatggtgacaatctaagattgttatcatatagcttttggattggccatccggtgattgttgagattatattactcatttgttttactacggttcttgcccaattgttacatttgcactaacata

SEQ ID NO: 862 - DNA, 711 bp, Unknown
  Description of Unknown: Human coxsackievirus A1, isolate KS-ZPH01F/XJ/CHN/2011, complete1 sequence
ttaaaacagctctggggttgttcccaccccagaggcccacgtggcggctagtacactggtatcacggtacctttgtacgcctgttttatatcccctcccccatgcaactttagaagtaattcaaatagttcaatagagggggtacaaaccagtaccaccacgaacaagcacttctgtttccccggtgaggctatatagactgttcccacggtcgaaggtggctgatccgttatccgcttgagtacttcgagaagcctagtaccacctttggatcttcgatgcgttgcgctcagcactctaccccgagtgtagcttaggctgatgagtctgggcataccccaccggcgacggtggcccaggctgcgttggcggcctacccgtggctaacgccatgggacgctagttgtgaacaaggtgtgaagagcctattgagctacttaagagtcctccggcccctgaatgcggctaatcccaaccacggagcaagtgctcacaaaccagtgggtggcttgtcgtaacgcgcaagtctgtggcggaaccgactactttgggtgtccgtgtttccttttatttttatcatggctgcttatggtgacaatctaagattgttgtcatatagcgtttggattggccatccggtgacttcgaaagcgatatatttgactcattgtcttactgaatttacctatttattacacttgtataacaata

SEQ ID NO: 863 - DNA, 711 bp, Unknown
  Description of Unknown: Human coxsackievirusA1, strain Tompkins, complete genome.1 sequence
ttaaaacagctctggggttgttcccaccccagaggcccacgtggcggccagtactctggtattgcggtacctttgtacgcctgttttatatcccctccccaagtaactttagaagcaattcacaaagttcaatagagggggtacaaaccagtaccaccatgaacaagcacttctgtttccccggtgaagctgtatagactgttcccacggtcgaaaatggcagatccgttatccgctcacgtacttcgagaagcctagtatcatcttggaatcttcgacgcgttgcgctcagcactctaccccgagtgtagcttaggccgatgagtctgggcataccccaccggcgacggtggcccaggctgcgttggcggcctacccatggctaatgtcatgggacgctagttgtgaacaaggtgtgaagagcctattgagctacttgagagtcctccggcccctgaatgcggctaatcctaaccatggagcaagtgcccacaagccagtgggtggcttgtcgtaatgcgcaagtctatggcggaaccgactactttgggtgtccgtgtttccttttattcttattatggctgcttatggtgacaacctaagattgttgtcatatagcttttggattggccatccggtgatctttgagattaatataccttccttattacttcatagtactcatttattcattacactactgtagttaca

SEQ ID NO: 864 - DNA, 711 bp, Enterovirus sp.
  D68, isolate 2012-12225, complete genome.1
ttaaaacagccttggggttgttcccacctcaagggcccacgtggcggctagtactctggtatttcggtacccttgtacgcctgttttatctccctccccaatgtaacttagaagctttcaaatcaaagctcaataggtggagcgcaagccagcgcttccgtgagcaagcactcctgtttccccggtgcggttgtatagactgttcccacggttgaaaacaacctatccgttatccgctatagtacttcgagaaacctagtatcacctttggattgttgatgcgttgcgctcagcacactaacccgtgtgtagcttgggtcgatgagtctggacataccccactggtgacagtggtccaggctgcgttggcggcctactcatggtgaaaaccatgagacgctagacatgaacaaggtgtgaagagtctattgagctactatagagtcctccggcccctgaatgcggctaatcttaaccatggagcaagtgctcacaaaccagtgagttgcttgtcgtaatgcgcaagtccgtggcggaaccgactactttgggtgtccgtgtttcactttttacttttatgactgcttatggtgacaatttaatattgttaccatttagctagtcaaattaatcacataaaaactttaaatcctatctaacaattcacatttggatagcttcattttgaggactttaaacctatttacaaag

SEQ ID NO: 865 - DNA, 711 bp, Coxsackievirus
  A9, isolate 2-MRS2013 polyprotein gene, complete cds.1
agggcccactgggcgctagcacactggtatcacggtacctttgtgcgcctgttttatttccccatccccgccgtaacttagaagtctcacttaagcggtcaatagatagcccagtaaaccaactgggttccgaccaggcacttctgttaccccggaccgagtatcaataggctactcacgtggccgaaggagaaaacgttcgttacccggccaattacttcgagaaacttagtaacaccatggaagttgcgcagtgtttcgctccgcacaaccccagtgtagatcaggtcgatgagtcaccgcgtaccccacgggcgaccgtggcggtggctgcgttggcggcctgcccatggggcaacccatgggacgcttcaataccgacatggtgcgaagagtctattgagctaattggtagtcctccggcccctgaatgcggctaatcctaactgcggagcagacgcctacgaaccagtgggtagtctgtcgtaacgggcaactctgcagcggaaccgactactttgggtgtccgtgtttccttttattcttacactggctgcttatggtgacaattgagagattgttaccatatagctattggattggccatccggtgacaaacagagctattgtttatctatttattggtttcataccactaaacttcaaggtcctaggaaccctcaatttaatattactacttaatagtgcaaa

SEQ ID NO: 866 - DNA, 712 bp, Canine kobuvirus 1
  isolate DD2 polyprotein mRNA, complete cds.1
tcaccctcttttccggtggtccggacccagaccaccgttactccattcagcttcttcggaacctgttcggaggaattaaacgggcacccactcaccctctcccccctctcgtaaccaagtgtgtgcccaatctcttcactcctgctggcttcaccgaccagcagtgtccaaaatgctaggtgaacctcctccctcccccactgggctcttgcccagtttcctccccccagcctgacgtgtcacaggctgtacaaagaccccgcgaaagctgccaaaagtggcaattgtgggtcccccctttgtgaaggcgtcgagtctttctcccttaaggctagacccgccagtgaattctgtcgggcaactagtgacgccactgcatgcctccgacctcggccgcggagtgctgccccccaagtcgagcccctaagccacaagttgtgctgtctggcaaacactgtctgtgagaatgttccgctgcggctgccaagcctggcaacaggctgccccagtgtgcgtagttctcatccagacctcggtctggcaacttgctgttaagacacggcgtaaggggcgtgtgccaacgccctggaacgagtgtccactctaataccccgaggaatgctacgcaggtacccctggcccgccagggatctgagcgtaggctaattgtctaagggtattttcatttcccactctttttctcttgttcata

SEQ ID NO: 867 - DNA, 712 bp, Canine kobuvirus
  US-PC0082, complete genome.1
tcacgcacttttccggtggtccggacccagaccaccgtcactccattcagcttcttcggaacctgttcggaggaattaaatgggcacccactcacccttcccctcttctcgtaactaagtgtgtgcccaatctcttgactcctactggctccaccgaccggtagtgtccaaaatgctaggtggacttcctcccttcccttctgggcatcttgcccagcttcctccccccagcctgacgtgtcacaggctgtgcaaagaccccgcgaaagctgccaaaagtggcaattgtgggtcccccctttgtcaaggcgtcgagtctttctcccttaaggctagtcccatcagtgaattctgatgggcaactagtgacgccactgcatgcctccgacctcggccgcggagtgctgccccccaagtcgtgcccctgaccacaagttgtgctgtctggcaaacattgtctgtgagaatgttccgctgtggctgccaagcctggtaacaggctgccccagtgtgcgtagttctcatccagacttcggtctggcaacttgttgttaagacacggcgtaaggggcgtgtgccaacgcccaggaacgagtgtccactctaataccccgaggaatgctacgcaggtacccctggtccaccagggatctgagcgtaggctaactgtctaagggtattttcatttcccactctctctttctcgttcata

SEQ ID NO: 868 - DNA, 712 bp, Bluegill picornavirus
  isolate 04-032, complete genome.1
tttaaatggtgaccttaaacgggaaatgcgttttccgttctttggatatccatttaacgtgtaccctatacgataattggggtggattctggatgcctagttccagtgattggttaagaactcgtttactacgtatagtatgattagcaaagtgctcgattgatcacgtaatgatctatgtggttaaaaacccagtagtatggtatatactcagtagtgtacactgtgagtacaactcttggcgtagagagaacaattcacccgaatccgtggcgtatccatggaaataagtttacctaattgtatgttacaaggcatatgagacatttatgagatatggtttattttgactaaacgagtgtagaggtggtggagtctatccaacttcaagccatgcaattgttgtgttgattgatatcattgaccatttttgtggattgtgtacacatacaatttgaaaattaaccccctcaagaataagacatgggaccattcgtggtagataccgtgctcggatgcttgagattagatgggttagactagttttggaatgagattgccgagaaagtcccgctagacatgttttacaagtcgtggtattccgctagactttttcgcagacacatggaagggtccatgtgttgtgcaattgcagggtgacagcccaactgcagagttttccttactagaataaaaatctgttgtcaatttt

SEQ ID NO: 869 - DNA, 712 bp, Unknown
  Description of Unknown: Human coxsackievirus A22, strain 438913, complete genome.1 sequence
ttaaaacagctctggggttgatcccaccccagaggcccacgtggcggctagtactctggtattacggtacctttgtacgcctgttttatatcccctcccccaagtaactttagaagcaattcaaacagttcaatagagggggtacaaaccagtaccaccacgaacaagcacttctgtttccccggtgaagctgtatagactgttcccacggttgaaaatggcagatccgttatccgcttgagtacttcgagaagcctagtatcaccttggaatcttcgacgcgttgcgctcagcactctaccccgagtgtagcttaggtcgatgagtctgggcataccccaccggcgacggtggcccaggctgcgttggcggcctacccatggccaacgccatgggacgctagttgtgaacaaggtgagaagagcctattgagctacttaagagtcctccggcccctgaatgcggctaatcccaaccacggagcaagtgctcacaaaccagtgagtagcttgtcgtaacgcgcaagtctgtggcggaaccgactactttgggtgtccgtgtttccttttatttttactatggctgcttatggtgacaatctaagattgttatcatatagctgttggattggccatccggtgatttattgagatttaacgttcgcctgtttttcttactacatctacccaccagtttcactcatataacaaca

SEQ ID NO: 870 - DNA, 712 bp, Human poliovirus 2
  gene for polyprotein, genomic RNA, strain1
cccacgtggcggccagtactccggtatcacggtacccttgtacgcctgttttatactcccttcccccgtaacttagaagcaatgaaaccaagttcaatagaagggggtacaaaccagtaccaccacgaacaagcacttctgtttccccggtgacgttgcatagactgtccccacggttgaaggcggctgatccgttatccgcttgtgtacttcgagaagcctagtaccatcttggaatctccgatgcgttgcgctcagcactcaaccccagagtgtagcttaggctgatgagtctggacattccccaccggcgacggtggtccaggctgcgttggcggcctacctgtggtccaaaaccacaggacgctagttgtgaacaaggtgtgaagagcctattgagctacatgagagtcctccggcccctgaatgcggctaatcccaaccacggagcaggtgtttgcaatccagcaaatagcctgtcgtaacgcgcaagtctgtggcggaaccgactactttgggtgtccgtgtttccttttattttcatactggctgcttatggtgacaatctcggattgttatcatagagcaaattggattggccatccggtgaaaatcagattgattatttaactttttgttggatttacatctttgacatcacatactccgaatctcattaagatagtgctcttgatacgacatcatcgtcatt

SEQ ID NO: 871 - DNA, 713 bp, Canine kobuvirus 1
  isolate 12D049, complete genome.1
tcacgcacttttccggtggtccggtctcagaccaccgttactccattcagcttcttcggaacctgttcggaggaattaaacgggcacccactaaccccaacccccttctcgtaactaagtgtgtgcccaatctcttgactcctgctggaaccaccgaccagtagtgtccaaaatgccaggtggaaaatcctcccttcccctctgggctacatgcccagcatcctccccccagcctgacgtgccacaggctgtgcaaagaccccgcgaaagctgccaaaagtggcaattgtgggtcccccctttgtcaaggcgtcgagtctttctcccttaaggctagccccgtcagtgaactctgtcgggcaactagtgacgccactgcatgcctccgacctcggccgcggagtgctgccccccaagtcatgcccctgaccacaagttgtgctgcctggcaagcactgcccgtgagaatgttccgctgtggctgccaagcctggtaacaggctgccccagtgtgcgtagttctcatccagacctcggtctggcaacttgctgttaagacatggcgtaaggggcgtgtgtcaacgccctggaacgagtgtccactctaataccccgaggaatgctacgcaggtacccctggctcgccagggatctgagcgtaggctaattgtctaagggtattttcatttcccactctctctttcttgttcata

SEQ ID NO: 872 - DNA, 713 bp, Hepatovirus A
  isolate 2ID, complete genome.1
atttaaaccctctcccttttggacttctctagtctggggaagtaaaataccagactcccgtttgcctagggtataggctattatttatgtttgttttgttatgtttgtcttttaatgttttgtaaatattaattccagcaggttctggtttctgaatttgtcctctttaaggcactcataatgctttctttcatcttcatttccctggctctcaccttgccagatggactgacccatgcgcccgtgggggttaaccacaggactagcctgtggctgtaggttctgaaagaggtgacattaagactatggttgtgattccacatgttttaactggtatgatgtagtagcaattgatctttggtatggggtaggctacgggtgaaaccccataggttaatactaatatttagagatacctccagtaggtgaagtgcacaggataagattgagttattttgacaaaagatcttcaactgtggtggacaccatctcactgggccaatgcttttgttatgaaaccatattgggcatgtctcttggatgagcattcatggacactgatgcctagactagggtgaatattgccttaaatcatagagttctttgggattttatggccttgcttctgttgaacagacactggggcttatggtattcaccctggcctctggggtaatcaggggcatttaggttttccacatttatataatgct

SEQ ID NO: 873 - DNA, 713 bp, Senecavirus A
  strain USA/IN_Purdue_4914-26/2015, complete genome.1
gctcctctgtgcctctagcaaacacagccggtttaccccccggaaggggaaaggaaggactgggcatgagggcccggccccccctttccccttccggggggtaaaccggctgtgtttgctagaggcacagaggagcaacatccaacctgcttttgtggggaacggtgcggctccaattcctgcgtcgccaaaggtgttagcgcacccaaacggcgcatctaccaatgctattggtgtggcctgcgagttctagcctactcgtttctcccctattcactcactcacgcacaaaaagtgtgttgtaactacaagatttagccctcgcacgggatgtgcgataaccgcaagattgactcaagcgcggaaagcgctgtaaccacatgctgttagtccctttatggctgcgagatggctatccacctcggatcactgaactggagctcgaccctccttagtaagggaaccgagaggccttcttgcaacaagctccgacacagagtccacgtgattgctaccaccatgagtacatggttctcccctctcgacccaggacttctttttgaatatccacggctcgatccagagggtggggcatgatccccctagcatagcgagctacagcgggaactgtagctaggccttagcgtgccttggatactgcctgatagggcgacggcctagtcgtgtcggttctataggtagcacatacaaat

SEQ ID NO: 874 - DNA, 713 bp, Echovirus
  E9 gene for polyprotein, partial cds,strain: 31170222.1
acagggcccactgggcgtcagcactctggtattgaggtacctttgtgcgcctgttttataaccctctccccatttgaaaattagaagcaatacacaatggtcagtagctggcatggcaaaccagtcatgttttgaccaagcacttctgtttccccggaccgagtatcaatagactgctcacgcggttgaaggagaaagcgttcgttacccgaccaactacttcgagaaacctagtaacgccatgaaagttgcagagcgtttcgctcagcacatccccagtgtagatcaggccgatgagtcaccgcattccccacgggcgaccgtggcggtggctgcgctggcggcctgcttgtggggcgacccacaagacgctccaaaacagacatggtgtgaagagtctattgagctagttggtagtcctccggcccctgaatgcggctaatcctaactgcggagcacgtgcctccaacccaggaggtggcgtgtcgtaacgggtaactctgcagcggaaccgactactttgggtgaccgtgtttccttttattcttatattggctgcttatggtgacaattgaaaggttgttaccatatagctattggattggccatccggtgacaaacagagcaattatatatctctttgttgggtatattccactcgattacaaggaattcagaactctcaattatatactgtctttaaactccgcaag

SEQ ID NO: 875 - DNA, 714 bp, Unknown
  Description of Unknown: Human coxsackievirus A21, strain USA-Ga95-10622 polyprotein gene,1 sequence
ttaaaacagcctgtgggttgttcccaccccagaggcccacgtggcggctagtactctggtatcacggtacctttgtacgcctgttttatatcccttcccccgcaactttagaagcttaacaaaagttcaacagcaggggtacaaaccagtgcctctacgaacaagcacttctgtttccccggtgaaatcacatagactgtacccacggtcaaaagtgattgatccgttatccgcttgagtacttcgagaagcctagtatcaccttggaatcttcgacgcgttgcgctcaacactctaccccgggtgtagcttaggctgatgagtctgggtactccccaccggtgacggtgacccaggctgcgttggcggcctacccatggctaatgccatgggacgctagttgtgaacaaggtgtgaagagcctattgagctactcaagaatcctccggcccctgaatgcggctaatcctaaccacggagcaatcgctcacgacccagtgagtaggttgtcgtaatgcgtaagtccgtggcggaaccgactactttgggtgtccgtgtttcccttttttattcatattggctgcttatggtgacaatttacagattgttaccatatagctattggattggccatccagtattgtgtcatacatattaaaatacttttctacaagcaataacaacattgtatttgaaccacaatagccattacaa

SEQ ID NO: 876 - DNA, 714 bp, Human enterovirus sp.
  94, isolate E210, complete genome.1
ttaaaacagcctgtgggttgttcccaccccagaggcccacgtggcggccagtactctggtatcacggtacctttgtacgcctgttttatatccccttcccccgcaacttagaagaaaacaaatcaagttcactaggagggggtacaaaccagtaccaccacgaacaagcacttctgtttccccggtgatgtcgtatagactgtaaccacggttgaaaacgattgatccgttatccgctcttgtacttcgaaaagcccagtatcaccttggaatcttcgatgcgttgcgctcagcactcaaccccagagtgtagcttaggtcgatgagtctggacactcctcaccggcgacggtggtccaggctgcgttggcggcctacctgtggtccaaagccacaggacgctagttgtgaacaaggtgtgaagagcctattgagctacaagagaatcctccggcccctgaatgcggctaatcctaaccacggagcaagggtacacaaaccagtgtatatcttgtcgtaacgcgcaagtctgtggcggaaccgactactttgggtgtccgtgtttccttttgtttttatcatggctgcttatggtgacaatctaagattgttatcatatagctgttggattggccatccggtaatttattgagatttgagcatttgcttgtttcttcaacaatttcacctattcattgcatttcagcagtcaaa

SEQ ID NO: 877 - DNA, 714 bp, Echovirus
  E25, strain 61243-1564 polyprotein gene, partial cds.1
cacagggcccactgggcgctagcactctggtattgcggtacctttgtgcgcctgttttatggcccccccccagttggaacttagaagtgaagcctctcgaccaatagtgggcgtggcacaccagccacgtcttggtcaagcacatctgtttccccggactgagtatcaataaactgctcgcgcggttgaaggagaaaacgttcgttacccggctaactacttcgggaaacccagtagtatcatggaaattgcgaggcgtttcgctcagcactccccccgtgtagatcaggtcgatgagtcactgcaccccccacgggtgaccgtggcagtggctgcgttggcggcctgcctatggggtgacccataggacgcttcaaaatggacatggtgcgaagagtctactgagctagttagtagtcctccggcccctgaatgcggctaatcctaaccgcggagcaagtgtccacaaaccagtgggttgcttgtcgtaatgggtaactctgcggcggaaccgactactttgggtgtccgtgtttccttttatcttttattatggctgcttatggtgacaattgagagattgttaccatatagctattggattggccatccggtgaacaacagagcgatcatttacctctttgttggtttcgttccattgagtcccaaagtttttacgacactcaaatttattctcctacttaacaaagcaaa

SEQ ID NO: 878 - DNA, 714 bp, Coxsackievirus
  B4, strain 61256-70969 polyprotein gene, partial cds.1
cagggcccactgggcgccagcacactggtatcaaggtacctttgtgcgcctgttttgcttccctttttccccagaggcaacttagaagcaatactccacgaccaatagcaggcgtggcacaccagccatgtctcggtcaagcacttctgtggccccggactgagtatcaataaactgctcacgcggtcgaaggagaaaacgtccgttacccggctagctacttcgagaaacctagtaacgccatgaaaattgcgaggcgtttcgctcagcacatccccagtgtagatcaggtcgatgagtcaccgcattccccacaggtgactgtggcggtggctgcgttggcggcctgcccatggggtaactcatgggacgcttcaatacggacatggtgtgaagagtctattgagctagttagtattcctccggcccctgaatgcggctaatcctaactgtggagcatgcgcccccattccagagggtagcatgtcgtaacgggtaactccgcagcggaaccgactactttgggtgtccgtgtttccttttattttatcattggctgcttatggtgacaattgaaagattgttaccatatagctattggattggccatccggtgacgaacagagctataatttaccaatttgtgggatttgttcctataagtttgaaagtcttaaagacccttaatttaatattactactcaatagtgcaag

SEQ ID NO: 879 - DNA, 714 bp, Coxsackievirus
  A19 clone V4C polyprotein gene, partial cds.1
tattaaaacagctctggggttgttcccaccccagaggcccacgtggcggccagtacactggtattacggtacctttgtacgcctgttttatatccccttacccagtaactttagaagtaattcacacagttcaatagagagggggtacaaaccagtaccaccacgaacaagcacttctgtttccccggtgaagctacatagactgtccccacggttgaaagtggcagatccgttatccgcttaagtacttcgagaagcctagtatcaccttggaatcttcgacgcgttgcgctcagcactctaccccgagtgtagcttaggctgatgagtctgggcataccccaccggcgacggtggcccaggctgcgttggcggcctacccatggctaacgccatgggacgctagttgtgaacaaggtgtgaagagcctattgagctacttaagagtcctccggcccctgaatgcggctaatcctaaccacggagcaagtgcccacaaaccagtgggtggcttgtcgtaacgcgtaagtctgtggcggaaccgactactttgggtgtccgtgtttccttttatttttatcatggctgcttatggtgacaatctaagattgttatcatatagctattggattggccatccggtgattcacagagacttgaaagctaactcaccttcctataacactcatttgtttatcaatcttatagcacaca

SEQ ID NO: 880 - DNA, 714 bp, Coxsackievirus
  B4 VP4 gene, partial sequence; VP2 (VP2) gene,2
ggcttaccaactatgcttacaccaggcagcacgcagtttttgacgtcagatgattttcaatcaccatcagctatgccacagtttgatgtgaccccagagatgaacattccagggcaagtgaggaacctgatggaaattgcggaagttgattctgtggtaccaatcaataacttgaaagctaatctgatgacgatggaggcttaccgggtgcaggttaggtccactgacgagatgggaggacagatatttggcttccccttacagccaggggcatcaagcgtgttacaaagaacactactgggagagatattaaattactacactcattggtcagggagcctcaagttaacatttgtgttctgtgggtcggcaatggcaactggcaaattcttactagcatactcaccacctggagcaggggcaccagacagcaggaagaacgctatgttagggacccacgtcatatgggacgttggactgcaatccagctgtgtgctctgtgtaccgtggatcagccagacgcactacaggtatgttgttgatgacaagtacacggctagtggtttcatttcgtgctggtaccaaactaatgtcatagtcccagctgaagctcagaaatcgtgctacataatgtgctttgtgtcagcatgcaacgatttctctgtacgcatgttgagggacacgcaattcattaagcaaacaaacttttatcag

SEQ ID NO: 881 - DNA, 715 bp, Ovine hungarovirus
  OHUV1/2009/HUN, complete genome.1
tctttcccccctcccctttccctttacctcttgcaacgaaacagtttttgacaaggaccctcacctgtcaatcgggaccaccactttcagtgaccccgtgcgaagtgttgagagaaagtgagctttcttacccttcatttgtgaacccttcagtcgaagccgcttggaataagatggaaggaaatgttcattctaaatggagtgaaacatatacttaatttccagtgtttagtggtctttccactagacaacggcactgtcttgccggaactctacacaccaacattccacgcttgtgggactcaaatgttggatgacacagttgtagctggaactgagtgtttagtgcactctgtgtaacagtgaaaacaatgtgatcacttcggtgggctagtagcctgtggactaacaactggtaacagttgcctcaggggccaaaagccacggtgttaacagcaccctactagtttgattggagcaatccatgatgttacagagttagtaactgccaaacagattgtactggtatcttggcataccgtgcaacttaggatagtgaaggatgccctggcggtacccataggtaacaagtgacactatggatctaaacaggggctcactctacgttgctttacaactagctgtgagttaaaaaacgtctaactatccacaacctaggggactaggttttcctttttatttttatacacaacta

SEQ ID NO: 882 - DNA, 715 bp, Unknown
  Description of Unknown: Human coxsackievirus A19, strain 8663, complete genome.1
ttaaaacagctctggggttgttcccaccccagaggcccacgtggcggctagtactctggtattacggtacctttgtacgcctgttttacactcccttccctacgcaactttagaagtttaacataaagttcaatagagggggtacaaaccagcaccaccacgaacaagcacttctgtttccccggtgaaactgcatagactgtaaccacggttgaaagcggttgatccgttatccgcttgagtacttcgagaagcctagtaccaccttggaatctccgatgcgttgcgctccacactctaccccgagtgtagcttaggccgatgagtctgggcgttccccaccggcgacggtggcccaggctgcgttggcggcctacccatggttaacgccatgggacgctagttgtgaacaaggtgtgaagagcctattgagctactcaagagtcctccggcccctgaatgcggctaatcccaaccacggagcgagtgctcacaatccagtgagtggcttgtcgtaacgcgcaagtctgtggcggaaccgactactttgggtgtccgtgtttccttttatttttactatggctgcttatggtgacaatctaggattgttatcatatagcttttggattggccatccggtgacttctaacgttcaagtagtttactcgcttaattttctaaacacattctcagttgttgaattataaacttcaca

SEQ ID NO: 883 - DNA, 715 bp, Unknown
  Description of Unknown: Human coxsackievirus A22, strain Chulman, complete genome.1 sequence
ttaaaacagcctggggttgttcccaccccagaggcccacgtggcggccagtactctggtattacggtacctttgtacgcctgttttatatcccctcccctgagtaactttagaagcaattcaaaaggttcaatagagggggtacaatccagtaccaccatgaacaagcacttctgtttccccggtgaggctacataaactgtacccacggttgaaagtggctaatccgttatccgctcaagtacttcgagaagcctagtaataccttggaatcttcgacgcgttgcgctcagcactctaacccgggtgtagcttaggtcgatgagtctgggcataccccaccggtgacggtggcccaggctgcgttggcggcctacccatggctaacgccatgggacgctagttgtgaacaaggtgtgaagagcctattgagctacttgagagtcctccggcccctgaatgcggctaatcctaaccacggagcaagtgctctcaaaccagagagtggcttgtcgtaacgcgtaagtctgtggcggaaccgactactttgggtgtccgtgtttccttttatttttatcatggctgcttatggtgacaatctaagattgttatcatatagcttttggattggccatccggttgttgtttagagcgtttcatctgtgctttgtttgtttgaccagatcaatataaacactacatcctatttgttcata

SEQ ID NO: 884 - DNA, 715 bp, Coxsackievirus
  B4, strain EPV3715, complete genome.1
acagggcccactgggcgttagcacactggtatctcggtacccttgtgcgcctgttttatacacccttcccccaaaagaaacttagaagcttgactataacggtcaataggaaacccagtataccagctgggttacgaccaagcacttctgtaaccccggactgagtatcaataggctgctcacgcggctgaaggagaaaacgttcgttacccggccaattacttcgagaaacctagtaccaccatgaaagttgcgcggcgtttcgctccgcacaatcccagtgtagatcaggtcgatgagccaccgcgttccccacgggtgaccgtggcggtggctgcgttggcggcctgcccatggggcaacccatgggacgcttcaatactgacatggtgcgaagagtctattgagctaattggtagtcctccggcccctgaatgcggctaatcctaactgcggagcagatacccacataccagtgggctgtctgtcgtaacgggtaactccgcagcggaaccgactactttgggtgtccgtgtttccttttattcttatactggctgcttatggtgacaattgagagattgttaccatatagctattggattggccatccggtgtctaacagagcgatcatctatctgtttgttggtttcatacccttgaattttaaagtcctcaacactcttaaccttgtgctacaactaaactcggtaaa

SEQ ID NO: 885 - DNA, 715 bp, Human poliovirus 3
  isolate EST02-E252 polyprotein mRNA, partial1
tgttcccaccccagaggcccacgtggcggctagtactctggtatcacggtacctttgtacgcctgttttatacccccttcccccgcaacttagaagcatgaaatcttaagctcaacaggaggggtgcaaaccagcacctctacgagcaagcactactgtctccccggtgaggttacatagactgttcccacggttgaaagtagccgatccgttatccgctcatgtacttcgagaagcctagtattgctctggaatcttcgatgcgttgcgctcaacactcgaccccggagtgtagcttaggccgatgagtctggacattccccactggcgacagtggtccaggctgcgttggcggcctacctgtggtccaaagccacaggacgctagttgtgaacagggtgtgaagagcctattgagctacatgagagtcctccggcccctgaatgcggctaatcccaaccatggagcaggcaactgcaacccagcagtcagcctgtcgtaacgcgcaagtccgtggcggaaccgactactttgggtgtccgtgtttccttttatcttttgaatggctgcttatggtgacaatcatagattgttatcataaagcgaattggattggccatccagagaattactaccgtgtttattgagtctactcttgaaaaacctaactcctcaacgtactagaattatttgaagacaggatatcgacacgaca

SEQ ID NO: 886 - DNA, 716 bp, Hepatitis A virus
  isolate CP-IND, complete genome.1
ttcaagaggggtctccggagatttcctgagtccctcttgggagtccatggtgaggggacttgatacctcaccgccgtttgcctaggctataggctaaacttccctttcccctttccctttattgttgtaaatattaattcctgcaggttcaggtctcttggatttgttccactttatggacactcatttcacgctttctgtctgcttttcttccagggctctccccttgccctaggctctggccgttgcgcccggcggggtcaactccatgattagcatggagctgtaggagtctaaattggggacacagatgttgggaacgtcaccttgcagtgttaacttggctttcatgaagctttttgatcttccacaagaggtaggctacgggtgaaacctcttaagctaatacttctatgaagagatgctttggatagggtaacagcggcggatattggtgagttgtttgacaaaaaccattcaacgccggaggactggctctcatccagtggatgcattaagtggattgtctgtcagggctgtctctaggtttaattcctggcctctctgtgcttagggcaaacaaaacttggccttaaatgaggtcctgtgagaggggacctcgccattgaatgctggacatttctttggggccttatgttttgtttgcctctgaggtactcaggggcatttaggtttttcctcatcaataaataatt

SEQ ID NO: 887 - DNA, 716 bp, Hepatitis A virus
  genomic RNA, complete genome, sub_strain:1
ttcaagaggggtctccgggtttttccggagcccctcttgggagtccatggtgaggggacttgatacctcaccgccgtttgcctaggctataggctaattttcccttttccttttccctgtgttattgtaaatattaattcctgcaggttcagggttcttgaatttgttctgctgtacggacactcttttcacgctctctgtctgcttttcttccagggctctccccttgccctaggctctggccgttgcgcccggcggggtcaactccatgattagcatggagctgtaggagtctaaattggggacacagatgttgggaacgtcaccttgcagtgttaacttggctttcatgaaactccttgatcttccacaagaggtaggctacgggtgaaacctcttaagctaatacttctatgaagagatgctttggatagggtaacagcggcggatattggtgagttgtatgacaaaaaccattcaacgccggaggactggctctcatccagtggatgcattgagtgaattgactgtcagggctgtctttaggcttaattcctgacctctctgtgcttagggcaaacaaaatttggccttaaatgaggctctgtgagagggggcctcgccattgaatgctggacatttctttggggccttatgttttgtttgccgctgaggtactcaggggcatttaggtttttcctcatcaataaataaat

SEQ ID NO: 888 - DNA, 716 bp, Enterovirus J
  strain POo-1, complete genome.1
aaaatagcctcagggttgttcccaccctgagggcccacgtggcgtagtactctggtatcacggtacctttgtacgcctattttacatcccttccccgtaacttagaagctttcaactataagttcactagcagggctaccaaccaggtagttcatcgaacaagcacttctgttaccccggtcctagtacctgagaagctgtacccacggcggaaggggaaaaagatcgttacccggctatctacttcgagaagcctagtaacgtcattgaaactcttgagcgttgcgttcagcacagtaccccctgtgtagctttggctgatgagtctgggcattccccactggcgacagtggcccaggctgcgttggcggccaaccgatccgggcaaccgggtcggacgctcatttgtggacatggtgtgaagagcctattgagctaggtagtagtcctccggcccctgaatgcggctaatcccaactccggagcaagtgcgcacaatccagtgtgtggcttgtcgtaatgcgtaagtctggagcggaaccgactactttgggtgtccgtgtttcctgtttttccttatttggctgcttatggtgacaatctagtgttgttaccatatagcgattggattggccatccggtgaatagctttgtgacaattccctacgttatttttcataactcaacttcacgagagtcattgagtttgactaatt

SEQ ID NO: 889 - DNA, 716 bp, Coxsackievirus
  B6 polyprotein gene for polyprotein, VP4 and VP2 and1
cacagggcccactgggcgctagcacactggtatcccggtacctttgtgcgcctgttttataccccctttcccgctttgtaacttagaagtaacacaacttcggtcaatagtcgacgcaacaacccagttgcgttttgatcaagcacctctgtgaccccggactgagtatcaataggctgctcgcgcggctgaaggagaaaccgttcgttacccggctaactacttcgagaagcctagtagcatcatgaacgttgcggagtgtttcgctcagcacttcccccgtgtagatcaggtcgatgagtcaccgcgttccccacgggtgaccgtggcggtggctgcgttggcggcctgcctgtggggcaacccacaggacgctctaatacagacatggtgcgaagagtctattgagctagttagtagtcctccggcccctgaatgcggctaatcctaactgcggagcacattctcacaagccagtgagcggtgtgtcgtaacgggcaactctgcagcggaaccgactactttgggtgtccgtgtttccttttattctaatactggctgcttatggtgacaattgagagattgttaccatatagctattggattggccatccggtgtctaacagagcaattatttacctgtttgttggtttcacacccctaaatctcaaggttttaaataccctcaatttcgtactgaaactaaactcagtaaa

SEQ ID NO: 890 - DNA, 716 bp, Enterovirus sp.
  D68, isolate USA/CA/2014-RGDS-1039, complete genome.1
cagccttggggttgttcccactccaagggcccacgtggcggctagtactctggtacttcggtacctttgtacgcctgttttatctcccttcccaatgtaacttagaagttcttaaatcaatgctcaataggtggggcgcaaaccagcgctctcatgagcaagcactcctgtctccccggtgaggttgtataaactgttcccacggttgaaaacaacctatccgttatccgctatagtacttcgagaaacctagtaccacctttggattgttgacgcgttgcgctcagcacactaacccgtgtgtagcttgggtcgatgagtctggacatacctcactggcgacagtggtccaggctgcgttggcggcctactcatggtgaaagccatgagacgctagacatgaacaaggtgtgaagagtctattgagctactatagagtcctccggcccctgaatgcggctaatcctaaccatggagcaagtgctcacaggccagtgagttgcttgtcgtaatgcgcaagtccgtggcggaaccgactactttgggtgtccgtgtttcactttttacttttatgactgcttatggtgacaatttgatattgttaccatttagcttgtcaaatcaattgcaaaagatcctaactcttatttatcaacttgcatctcgataactctaatttgaaaatatcatctctaaccaatttgaaaattttaaca

SEQ ID NO: 891 - DNA, 717 bp, Coxsackievirus
  A6, isolate DY003R/Shandong/China/2015, complete1
acagggcccactgggcgctagcactccgattctgcggaatctttgtgcgcctgttttataaccctcccccgaaacttgcaacttagaagttatgtacgttactgatcaacagcaggcgtggcacaccagccatgtcttgatcaagcacttctgtaaccccggactgagtatcaatagactgctcacgtggtcgaaagagaaaacgttcgttatccggctaactacttcgagaaacttagtagcaccactgaaactgcggagtgtttcgctcagcacttcccccgtgtagatcaggtcgatgagtcactgcttaccccacgggtgaccgtggcagtggctgcgttggcggcctgcctatggggcaacccataggacgctctaaagtggacatggtgtgaagagtctattgagctagttagtagtcctccggcccctgaatgcggctaatcctaactgcggagcacatgccctcaatccagggggtggtgtgtcgtaacgggcaactctgcagcggaaccgactactttgggtgtccgtgtttcttttattctcataatggctgcttatggtgacaattgaggaattgttgccatatagctattggattggccatccagtgacaaacagagctttgatatacttgttcgtgggtttcgttccactcaccagtcgtacagttcatactctaaagtacattctgattctgaacaatagaaa

SEQ ID NO: 892 - DNA, 717 bp, Human enterovirus sp.
  C104, strain Pavia259-7712, complete genome.1
ttaaaacagcttgggggttgttcccacccccagggtccaatggacgctagtacaccggtatcacggtacccttgtacgcctgttttataatccccttcccccgtaacattagaagcacaaaagcaaccgctcaatagacaccatacatccagtgtggttacgagcaagcacttctgtctccccggttgcgccctatatgctgtgcgaacggcaaaaaggggcaatatcgttacccgcttgactactacgggaaacccagtatcatcttcgattgatttgagagttgcgttcagcgccttacccccggcgtagctcaggctgatgaggctccgaacaccccacaggcgactgtgtcggagcctgcgttggcggcctgcccataccctgcggtatgggacgctcacttcatgacatggtgcgaagagtctactgtgctagtcaagattcctccggcccctgaatgtggataatcccaaccactgatcctacgttcgcaatccagcgttcagtaggtcgtaacgcgcaagtcggtggcggaaccaactactttgggtgtccgtgtttcctttatttcctactgaatgcttatggtgacaattgttttgatcagttgttgccaatactcgcgttcagtgtgtaattacaaaaacaagattatcagttattacaatccctcacgttcagtgcacaattacgaaaacgagattttctgtcata

SEQ ID NO: 893 - DNA, 719 bp, Coxsackievirus
  A10, strain 61217-2276 polyprotein gene, partial cds.1
acagggcctactgggcgctagcactctgattctacggaacctttgtgcgcctgttttataacccctcccccaaactatgtaacttagaagttatgcactctaccgatcaacagcaggcatggcgctccagccatgtctcgatcaagcacttctgtttccccggactgagtatcaatagactgctcacgtggtcgaaggagaaaacgttcgttatccgactaactacttcgagaagcctagtagcaccatcgagactgcggagcgtttcgttcagcactccccccgtgtagatcaggtcgatgagtcactgcataccccacgggcgaccgtggcagtggctgcgttggcggcctgcctatggggtgacccataggacgctctaaagtggacatggtgtgaagagcctattgagctagttagtagtcctccggcccctgaatgcggctaatcctaactgcggagcgcatgccctcgaaccagagggtagtgcgtcgtaacgggcaactctgcagcggaaccgactactttgggtgtccgtgtttctttttattcacttattggctgcttatggtgacaatcaaggaattgttaccatatagctgttggattggccatccggtgtgtaatagagcaattatctatttgtttgttggttacattccattaacatttaagtccctcaatacattacactacattttaaccctaaacgcaagaag

SEQ ID NO: 894 - DNA, 719 bp, Human poliovirus 1
  strain NIE1116622, complete genome.1
ccagaggcccacgtggcggctagtactccggtattacggtacccttgtacgcctgttttatactcccttccccgtaacttagaagaaccaaaccaagttcaatagaagggggtacaaaccagtaccaccacgaacaagtacttctgtttccccggtgaagttgtatagactgtacccacggttgaaaacgactgatccgttatccgctttcatacttcgagaagcctagtatcatcttggaatcttcgatgcgttgcgctcaacactcaaccccagagtgtagcttaggctgatgagtctggacgtccctcaccggcgacggtggtccaggctgcgttggcggcctacctgtggcccaaagcctcaggacgctagttgtgaacaaggtgtgaagagcctattgagctatgaaagagtcctccggcccctgaatgcggctaatcccaaccacggagcgagagtgtgcaaaccagcgcatttatcgtcgtaacgcgcaagtctgtggcggaaccgactactttgggtgtccgtgtttccttttatttttctacattggctgcttatggtgacaatcatagattgttatcataaagcgaattggattggccatccggtgaaagtgaaacatattattcacctccttgttggatttactccaatcaacctctccacttataagattatcatcacagtcttaccaaatagaagcatattcaaca

SEQ ID NO: 895 - DNA, 720 bp, Chicken picornavirus 1
  isolate 55C, complete genome.1
ctgcttaaggacgttcccggtgctgttgatgctttccgtcaggcagtggccgacttgcagaacttcctaccgaaccaccacctcacccccataactccttccctctacaccttccgctatggtggttaccactgctttattgccttgactgagaatggccaccccctcgacacctgccccctactgccccaccgcgcaaccttttgcttgtccactcggttggagaggcatgggggccccgttcatatccccagtccagttggtgaccttccccctccccgtccggtagatggtccagagggctttgccgacgccctctatgatgcttgcttgtctttcctccgtcagcgcgagcatgcacttgtcgagcccacggaaacacagcctagcttttgcttctctcaccctgcgtaccctgggcgccttccgctcgagattcgctttgttcgacaccctggcgtccccccaccgctacgtgattttactcgtggcatacaccgccctggcgttcagtacattccactgcctaatttgggtggcctccctcaatctcccgcaccccccattgcgcacgtcatcaccgccgccgctaacgcgatccggcgcggttctcactggcactgtcccctcgtccgccgggtttccactcatggttggcttttcacttattctggttactggtgttccatcctacttcatgatggtcgccatgaccatgac

SEQ ID NO: 896 - DNA, 721 bp, Rosavirus C
  strain RASK8F polyprotein gene, complete cds.1
gggatgggtctggtgctgcgccgcgtgtgtcttgacaccgcgctgctcaggatgcttctgccccgtgctttggacgcctaccagggcgttaaactggtcccccccttaccctttccccgtaactaagtttgtacctcccccatataggctgctaagacgcttgttgctacagcatatgtggatcagggagttctccatgagtaatcttttccaccctctctagtgtctatgctattgaggacgggttggagccccgttgacctagtgtcagagtgtgtcggtagcaggctttctgctctcgccccatgccggccacacctcccgtcagtaatgtgaagactgcaagttgcatgtgaaaaggtttctaatatttgagctgaatgtagcgattacccaaggtgagcggacttccccacgtggtaacacgtgcctctcaggccaaaagccaaggtgttaaaagcaccccttgggtagaccactaccccgtggtctcagttctcttagaagattcacttagtaatgtgtatactggcagctcccaagcagagctggcgagcgggctaaggatgccctgaaggtacccgcaggtaacgttaagacactgtggatctgatcaggggctcgagtgctgaagctttacagaggtagctcgagttaaaaaacgtctatgcccctcccccacgggagtgggggttcccccacaccaattttagattgcact

SEQ ID NO: 897 - DNA, 721 bp, Picornaviridae sp.
  isolate nut157pic2 genomic sequence.1
aaactattgggtgtcaattcagaaactgcagccaaagctgaggtggtaactgactcctcaagagcagcagctgttgcagcagcattctgggcaatttgatccaaaccagtcactctatcagttgccatttttcacaccatacataaaattttcaatggaataaaagggaaaatgctcaaacatgtttttcataattttaaacccataacctggtaaagccaaactatgggtcccagatcagattcataaaatgagtaccttttggagcttggaaactccttgggaaagatgctaaaggagtatctgttacaaggttggtaacctgtcctcttttataggcaaacaactcatacataaatgaccaagacaagatctcctttgacagaacttggatgagttacttttgttccctctgtgcccagggccttaggtatggtaacatacaccctgggggccaaaagcctagtgagtcgaaactcacctggaggtgggcctttacggccacttgtccattagtatgcattggatgctgtcctgtctgaactcatttatgtgtgcaagtcttgaacatgttgagtagacccccagaaggtactcattttatgaatctgatctgggacccatagtttggctttaccaggttatgggtttaaaattatgaaaaacatgtttgagcattttcccttttattccattgaaaattttatgtatggtgtgaaaa

SEQ ID NO: 898 - DNA, 721 bp, Coxsackievirus
  A4, isolate C019/CHW/AUS/2016 polyprotein gene,1
ccacccacagggcccactgggcgctagcacactgattctacggaaactttgtgcgcctgttttatacccctccccaaatgagtaacttagaagtttaatatgttcatgaccaatagcaggcgtgacacaccagtcacgtcttggtcaagcactcctgtttccccggactgagtatcaataagctgctcacgcggctgaaagagaaaacgttcgttacccggctaactacttcgagaaacctagtaacaccatgaaagttgcagagtgtttcgttcagcacttcccccgtgtagatcaggtcgatgagtcactgcaaaccccacgggtgaccgtggcagtggctgcgttggcggcctgcccatggggtaacccatgggacgctctaatacagacatggtgcgaagagtctattgagctagttagtagtcctccggcccctgaatgcggctaatcctaactgcggagcacataccctcaatccagagggcagtgtgtcgtaacgggcaactctgcagcggaaccgactactttgggtgtccgtgtttccttttatctcattatggctgcttatggtgacaattgaagaattgttaccatatagctattggattggccatccggtgtctaacagagcaattgtatttctatttgttggatttgttcctttgtcgcacacatctctcaatactttatactacattataaagttaaatacaggaag

SEQ ID NO: 899 - DNA, 721 bp, Echovirus
  E24, strain VEN/2018-23086, complete genome.1
cccacccatagggcccactgggcgctagcacactggtatcacggtacctttgtgcgcctgttttatttaccctcccccaactgaaaattagaagccaaactcaaacggtcaataggaaacccagtgaaccaactgggctgcgaccaagcacttctgttaccccggactgagtatcaataggctgctcgcgcggctgaaggagaaaacgttcgttacccggccaattacttcgagaaacctagtaccaccatgaaagttgcgaaacgtttcactccgcacaaccccagtgtagatcgggtcgatgagtcaccgcattccccacgggtgaccgtggcggtggctgcgttggcggcccgcccatggggcaacccatgggacgcttcaatactgacatggtgtgaagagtctattgagctaattggtagtcctccggcccctgaatgcggctaatcctaactgcggatcagacacccacacgccagtgggcagtctgtcgtaatgggcaactctgcagcggaaccgactactttgggtgtccgtgtttctttttatccttatactggctgcttatggtgacaattgaaagattgttaccatatagctattggattggccatccggtatctaacagagctattatttacttatttgttggtttcgtacctctcagtatcagagttttgagaacacttaacttcatactactgctaaacactgcaag

SEQ ID NO: 900 - DNA, 722 bp, Simian agent 5
  strain B165, complete genome.1
ttaaaatagcctgtgggttgctcccacccacagggcccaagtggcgtagtacttggtattccggtacctttgtacacctatttacaaaccctaccccttgtaaccttagaagcaattatttaaccgctcactagggggtgtgctatccaagcacatcaagagcaagcacttctgtctccccgggaggggctaatggtacgctgtgcccacggcggaaatgagccctaccgttaaccggcagtctacttcgggaagcccagtaactacattgaaactttgaggcgttacactcagcacataaccccaatgtgtagttctggtcgatgagccttggcatcccccacaggcgactgtggccaaggctgcgttggcggccagcctgcggaccaaaagtccgtaggacgcctaattgtggacatggtgtgaagagcctactgagctagactgtagtcctccggcccctgaatgcggctaatcctaaccctggagcatccgcgtgcaacccagtacgtagggtgtcgtaatgcgtaagtctgggatggaaccgactactttgggtgtccgtgtttcttgtttttcatactgggtcgcttatggttacaactaattgttgtaatcattggcagtgcgcgctgaccacgcgattattgatatttccatttgttggatactccaatagtgtcaactcatatacacaacttttaccactgatcaagataaaa

SEQ ID NO: 901 - DNA, 723 bp, Bat hepatovirus
  BUO2BF86Colafr2010 polyprotein gene, complete cds.1
ttcaaaagtccctccgggaatttcccggaggacttttgggccaccattgcaaggggtggttttaaccttgcacgcgtttaccgtgcgttaacggttttccatgtttgtatgtcttgtttgtattatgtgttttgtaaatattaattcctgcaggttcagggttctttaatcatgttgggctgtacccacactcaacttttggccataagtgagtttcttaacgaaccttttaacacaggatgttattagggcccaatattttccctgaggccttctttggcctctattttttccccttttctatctccttgtattccgggctcacgtgatgccaatggactgacccatgcgcccgtgggggttaactactggagtagccagtagctgtaggtgctaaaagtcacgtacgtgtaagactggacgagacctctcagctataactgaaagtagtaagtatgtctgaacttcttgaaggggtaggctacgggtgaaaccccttaggttaatactcatattgagagatacctctgataggtgaaggtttccggtagaggtgagtttaacgacaaagcctctcaacggatgtgggcccacctcatcagcaagatgctttcatacccaataccgtaggggctgggttgttgagttcagtcccaagcgtccctcccgcaaggttgtaggggtactcaggggcatttaggtttccacaattaaacaaataca

SEQ ID NO: 902 - DNA, 723 bp, Coxsackievirus
  A5, isolate C026/CHW/AUS/2016 polyprotein gene,1
ccacccacagggcccactgggcgttagcactctggtaccacggtacctttgtgcgcctgttttatccccccaaacccccgtaacactacactagaagatagacaatgcgaccaatagccagtggggcaacccagcctcaccttggtcaagcacctctgttttcccgggcttagtaccaataagctgctcgcgtggctgaaggggaacgcgctcgttatccggctaactacttcgagaaacctagtatcaccatggaagttgcagagtgtttcgatcagcacaaccccagtgtagatcaggccgatgagtcaccgtgtaccccacgggcgaccgtgacggtggctgcgttggcggcctgcccatggagtacaccatgggacgctctaatacagacatggtgcgaagagtctattgagctagttagtagtcctccggcccctgaatgcggctaatcctaactgcggagcacgcgctctcaacccagagagtagcgtgtcgtaacgggcaactctgcagcggaaccgactactttgggtgtccgtgtttctctttattcttacattggctgcttatggtgacaattgaaagattgttaccatatagctattggattggccatccggtgtgcaacagagctatcatatattcttttgttggctttgtgccactagattatactgcaattattactttaaggtatatcttgcttttgaacacagcaaa

SEQ ID NO: 903 - DNA, 723 bp, Echovirus
  E11, isolate E11-NHP-RD31, complete genome.1
ggttgcccacccacagggcccactgggcgctagcacactggtatcacggtacctttgtgcgcctgttttatccaccctccccaacgtaacttagaagcttatttaaaccgaccaacagacggtccagcataccagctgggttacggtcaagcacttctgttaccccggactgagtatcaataggccgctcgcgcggctgaaggagaaaacgttcgttacccggccaattacttcgagaaacctagtaccaccgtggaggtcgcgaagtgtttcgctccgcacaaccccagtgtagatcaggtcgatgagtcaccgcattccccactggcgacagtggcggtggctgcgtggcggcctgcccatggggtaacccatgggacgcttcaatactgacacggtgtgaagagtctattgagctaattggtagtcctccggcccctgaatgcggctaatcctaactgcggagcagatatccacgagccagtggacagtctgtcgtaatgggtaactctgcagcggaaccgactactttgggtgtccgtgtttccatttattcctatactggctgcttatggtgacaattgagagattgttaccatatagctattggattggccatccggtgacaaacagagcaattatatatctctttgttggttatattccactcaacattaaggttttaagaacgcttaattacatcctattgttaaacacattaag

SEQ ID NO: 904 - DNA, 723 bp, Echovirus
  E3, strain HAI/2016-23050 polyprotein gene, complete cds.1
ttcccactcacagggcccactgggcgctagcacactggtatcccggtacctttgtgcgcctgttttataccccctcctccaaccgtaacctagaagcagcaccatatggccaatagtagacgtggcgcaccagccacgttttggtcaagcacttctgtttccccgggccgagtatcaataggctgctcacgcggctgaaggagaaagcgtccgttacccggccaattacttcgagaaacctagtaccaccatggaagttgcgcggcgtttcgctccacacaaccccagtgtagatcgggtcgatgagtcaccgcatttccccacgggtgaccgtggcggtggctgcgttggcggcctgcccatgaggaaactcatgggacgcttcaatactgacatggtgtgaagagtctattgagctaattggtagtcctccggcccctgaatgcggctaatcctaactgcggagcagatgctcacaaaccagtgggtggtctgtcgtaatgggcaactctgcagcggaaccgactactttgggtgtccgtgtttccttttattttcacactggctgcttatggtgacaattgaaggattgttaccatatagctattggattggccatccggtgacaaacagagcgattgtctatctatttgttggttttgtaccattagatttcaaagtcctgaaaaccctcaatttcgtcttaacactcaattcggcaag

SEQ ID NO: 905 - DNA, 723 bp, Enterovirus B
  isolate HB92, complete genome.1
tgatcccacccatagggcccactgggcgccagcacactggtattacggtacctttgtgcgcctgttttatctaccccccccaacgcaactcagaagctcaactgaaccgaccaatagatgacccggcaagccagcagggccctggtcaagcacttctgttaccccggactgagtatcaataagctgctcgcgcggctaaaggagaaaacgttcgttacccggccaattacttcgagaaacccagtaccaccgtgaaagttgcgcagtgtttcgctccgcacaaccccagtgtagatcaggccgatgagtcaccgcattccccactggtgacagtggcggtggctgcgttggcggcctgcccatggggcaacccatgggacgcttcaatactgacacggtgcgaagagtctattgagctaattggtagacctccggcccctgaatgcggctaatcctaactgcggagcagatacccacgcgccagtgggcagtctgtcgtaatgggcaactctgcagcggaaccgactactttgggtgtccgtgtttccttttattcttatactggctgcttatggtgacaattgaaagattgttgccatatagctattggattggccatccagtgactaacaaagcaattgtctatctatttgttggttttataccattaaactacaaagctataagcacactcaaatttatattggtactcaactcagcaaa

SEQ ID NO: 906 - DNA, 724 bp, Coxsackievirus
  A5, isolate C027/CHW/AUS/2016 polyprotein gene,1
ccacccgcagggcccactgggcgccagcactctgattctgcggaatctttgtgcgcctgttttataaccccttccccaaatttgcaatttagaagcaaagcacactaacgatcaacagcaggcgtggcataccagctacgtcacgatcaagcacttctgtttccccggactgagtatcaataagctgcttgcgcggctgaaggagaaaatgtccgttatccggctaactacttcgagaaacctagtagcaccattgaagctgcagagtgtttcgctcggcacttcccccgtgtagatcaggtcgatgagtcactgcactccccacgggcgaccgtggcagtggctgcgttggcggcctgcctatggggcaacccataggacgctctaatgtggacatggtgtgaagagtctattgagctagttagtagtcctccggcccctgaatgcggctaatcctaactgcggagcgcatgcccccaaaccagggggaggtgcgtcgtaatgggcaactctgcagcggaaccgactactttgggtgtccgtgtttccttttatctttatattggctgcttatggtgacaattgagagattgttaccatatagctattggattggccatccggtgagcaatagagcaattatttattcctttattggatttgtaccgttgaattatactgcttttattacactgaaacacatcctattgttgaacacaataaa

SEQ ID NO: 907 - DNA, 724 bp, Enterovirus sp.
  C96, isolate 3499/BRA-PA/10, complete genome.1
ggggttgttcccaccccagaggcccacgtggcggccagtacaccggtatcacggtacccttgtacgcctgttttatactcccttccccgtaacttagaagtaacaaacctatgttcaatagaagggggtacaaaccagtaccaccacgaacaagcacttctgtttccccggtgagatcacatagactgttcccacggttgaaagtgatcgatccgttatccgctcttgtacttcgagaagcctagtattatcttgggaccaacgatgcgttgcgatcagcactcgaccccagagtgtagcttaggtcgatgagtctggacattcctcaccggtgacggtggtccaggctgcgttggcggcctacctgtggcccaaagccacaggacgctagttgtgaacaaggtgtgaagagcctattgagctacatgagagtcctccggcccctgaatgcggctaatcctaaccacggagcaggcgattgcaaaccagcaattagcttgtcgtaatgcgtaagtctgtggcggaaccgactactttgggtgtccgtgtttccttttattttatcaatggctgcttatggtgacaatcatagattgttgtcataaagcgaattggattggccatccggtgacgttcagagttatttgtttgtgaaattcattctctcaatcctgtccacatttgacatacttccttaaatctttatacagaacaccttaacaca

SEQ ID NO: 908 - DNA, 724 bp, Enterovirus sp.
  C99, strain 10L1 polyprotein gene, complete cds.1
caccccagaggcccacgtggcggctagtactccggtatcacggtacccttgtacgcctgttttatgctcccttccccttgtaacttagaagcaaacaacactagttcaataggagggggtacaaaccagtaccaccacgaacacgcacttctgtttccccggtgaagctgcataagctgttcccacggctgaaagcgactgatccgtcatccgctcaggtacttcgggaagcctagtaccatcttggaatcttcgatgcgttgcgctcagcactcaaccccagagtgtagcttaggctgatgagtctggatgtgcctcactggtgacagtggtccaggctgcgttggcggcctacccatggcccaaagccatgggacgctagttgtgaacaaggtgtgaagagcctactgagctacctgagagtcctccggcccctgaatgcggctaatcccaaccacggagcgagtgcccacaatccagtgagtggctcgtcgtaatgcgcaagtctgtggcggaaccgactactttgggtgtccgtgtttccttttaaccttattatggctgcttatggtgacaatcatagattgttatcataaagcgaattggattggccatccggtgaaagtcagaacgctaatttatctgtttgttggatacaccaaagttaactgcaatacactaaccttgattcgcatagtgttgttaattagatatcattaccaca

SEQ ID NO: 909 - DNA, 725 bp, Tasmanian devil-associated sapelovirus
  isolate1
tggggaggtgcctcctccccattgcagagtgctttgtcctacgggtcaagtacctgccgttgttggtgttcccacgggtgcagtcagcaaagcccccttttcgccccttccccctcacctaacctttttcccctctctttggcaagcgatgaaaggattacgagcaaggtttgcggaagaattgttatggcgattgcggaagaatatggattaaggattttccacgtaccttagatgatcataggtggctttcacctctggaccagtgatcaaacgtggaccatagtttaagtgaagtaagcatgttccaggtgaaaacgcatattgaaatgaacgtgtctgtagcgacctccaagtgcgcatggcctcccatgatggtgacatcatccatgcggaccaaaagtcaagtgtgcagtgacgtgcgaataatagactgtacccacggttgaagattcgcacggcatgagttcaccacttggagcggccgaccccgggccacacgggattggagatgtgcttgagtaatctggaagaggcttatataaacactctatgggggctgtgaagaatgccatgcaggtaccctcacacagaggatctgagcattgggccacggagacgatctataaactcgaagtggttgaaaagtatctaagcagcccgcaaggggcccatggttgggcccctctattttccccttattattttatcagtggtgacaatag

SEQ ID NO: 910 - DNA, 725 bp, Coxsackievirus
  A4 gene for polyprotein, polyprotein region,strain1
ttcccacccacagggcccactgggcgctagcacactgattctacggaaactttgtgcgcctgttttatacctcctccccgaagagtaacttagaagcttaacatacccatggccagcagcaggcgtgacataccagtcatgccccggtcaagcacttctgtctccccggactgagtatcaatagactgctcgcgcggttgaaggagaaaacgttcgttatccggctaactacttcgagaaacctagtaacaccatgaaagttgcagagtgtttcgttcagcacttcccccgtgtagatcaggtcgatgagtcactgcaaaccccacgggcgaccgtggcagtggctgcgttggcggcctgcccatgggaccacccatgggacgctctaatacagacatggtgtgaagagtctattgagctagttagtagtcctccggcccctgaatgcggctaatcctaactgtggagcacacgccctcaacccagggggtagtgtgtcgtaatgggcaactctacagcggaaccgactactttgggtgtccgtgtttccttttatctttatattggctgcttatggtgacaattgaagaattgttaccatatagctattggattggccatccggtgtctaatagagcaattgtatacctatttgttggatttgtccccttgtcatacacatctataaacaccctacaatatattgtaaaattgaatacaggaaa

SEQ ID NO: 911 - DNA, 725 bp, Coxsackievirus
  A4, isolate C040/CHW/AUS/2016 polyprotein gene,1
ccacccacagggcccactgggcgttagcacactgattctaaggaatctttgtgcgcctgttttatatccctcccccccaaaagtgtaacgtagaagtttaatacactcacgaccaatagcaggcgtgacgcaccagtcacgtcttggtcaagtacttctgtctccccgggccaagtatcaatagactgcttacgcggttgaaggagaaaacgctcgttacccggctaactacttcgagaaacccagtagcaccatgaaagttgcagggtgtttcgttcagcacttcccccgtgtagaccaggtcgatgagtcactgcaaaccccacgggcgaccgtggcagtggctgcgttggcggcctgcccatggggtaacccatgggacgctctaatacagacatggtgtgaagagtctattgagctagttagtagtcctccggcccctgaatgcggctaatcctaactgcggagcacacaccctcaacccagggggcggtgtgtcgtaacgggtaactctgcagcggaaccgactactttgggtgtccgtgtttccttttatatttattatggctgcttatggtgacaattgaagaattgttaccatatagctattggattggccatccggtgtctaacagagcaattgtatacctatttgttggatttgtccctctgtcacacacacctctcaataccctatactatattatagagttgaatacaggaag

SEQ ID NO: 912 - DNA, 725 bp, Coxsackievirus
  A10, strain 13-2591-2, complete genome.1
ttgctcccacccacagggcccactgggcgctagcaccctggtgccacggcacctttgtgcgcctgttttatcaccctaccccatatgaaacttagaagtaatacatagccgaccaatagcaggtgtggcgtgccagccacatcttggtcaagcacttctgtttccccgggtcgagtatcaataagctgttcacacggctgaaggagaaaacacccgttatccggccaactacttcgagaaacctagtaccaccatgaacgttgcaaggtgtttcgctcagcacttcccccgtgtagatcaggccgatgagtcaccgcataccccacgggtgaccgtggcggtggctgcgttggcggcctgcctatgggttaacccataggacgccttaatactgacatggtgcgaagagtctattgagctagttggtagtcctccggcccctgaatgcggctaatcctaactgcggagcacacactcacaaaccagtgagcggtgtgtcgtaacgggcaactctgcagcggaaccgactactttgggtgtccgtgtttccttttacctttatattggctgcttatggtgacaatcagagaattgttaccatatagctattggattggccatccggtgtctaatagagctattgtatatctgtttgttggattcactccgctgacctacaaatctctaaacaccttgtgctatattttgaatctaaatacacgaaa

SEQ ID NO: 913 - DNA, 725 bp, Enterovirus sp.
  isolate CPML_8109/08, complete genome.1
ttaaaatagcctgagggttgttcccacccacagggcccacgtggcgcagtactctggtatcacggtacctttgcacgcctattttataccccttccccatcgtaacttagaagcaacaaacaaactgcccaatagcagcacaacacccagttgtgttaggggcaagcacttctgtttccccggaagggtctgacggtatgctgtacccacggcagaagtatgacctaccgttaaccggccatgtacttcgagaagcctagtaccattatgaaggttgattgatgttacgctccccagcaaccccagctggtagttctggtcgatgagtctcggcattccccacgggcgaccgtggccgaggctgcgttggcggccagcctacaccatacggtgtaggacgtcaagatactgacatggtgtgaagagcctattgagctacgtggtagtcctccggcccctgaatgcggctaatcctaactccggagcatccgccagtaagcccactggaagggtgtcgtaatgcgaaagtctggagcggaaccgactactttgggtgtccgtgtttcctgttttacttattgtttggctgcttatggtgacaacttatagttatcatcataagctacttggtcttgccaaccggagaattatttggttatttgttggtttcataaacctacagtcgtattttcctgtcttattaattgttctcaaaattaacaaca

SEQ ID NO: 914 - DNA, 725 bp, Enterovirus sp.
  D, isolate EV-D111_CAF-NGB-06-107 polyprotein gene,1
ttcccaccctagaggcccacgtggcggctagtactctggtattacggtacctttgtacgcctgttttatattccttcccctatcgtaacttagaagtttcaaacacagctcaacagacagtagtacataccagtactgctacgagcaagcacttctgttaccccggtgaagtcacatagactgtgcccacggttgaaagtgactgatccgttacccgctttagtacttcgagaagcctagtaatatcttggaatcttcgatgcgttgcgctcaacactcaaccccagagtgtagcttaggtcgatgagtctggacactccccaccggcgacggtggtccaggctgcgttggcggcctacctgtggcccaaagccacaggacgctagttgtgaacaaggtgtgaagagcctattgagctactaaagagtcctccggcccctgaatgcggctaatcccaaccacggagcaagtgctcacaatccagtgagtggcttgtcgtaacgagcaattctgtggcggaaccgactactttgggtgtccgtgtttccttttatttttatcattggctgcttatggtgacaatctaagattgccatcatatagcttttggattggccatccggtgatattttgaattactcagcttgctgttcacagcactcttcaaatagtaattatttattaccacctgcagtttgttcttaaattgtctccagacagtcaaa

SEQ ID NO: 915 - DNA, 725 bp, Enterovirus sp.
  B, isolate E-19_CAF-BAN-05-150a polyprotein gene,1
atcccacccacagggcccattgggcgctagcacaccggtattacggtacccttgtgcgcctgttttatacaccctacccccaaaacgtaatttagaagcaagtcaacaaagaccaatagcaagcacggcacaccagctgtgttttggtcaagcacttctgttaccccggactgagtatcaataggctactcacgtggctgaaggagaaaacgttcgttatccgtccaattacttcgagaagcctagtaacaccatagaggttgcgcagcgtttcgctccgcactaccccagtgtagatcaggtcgatgagtcaccgcattccccacgggtgaccgtggcggtggctgcgttggcggcctgcccatggggcaacccatgggacgcttcaatactgacatggtgcgaagagcctattgagctaattggaagtcctccggcccctgaatgcggctaatcctaactgcggagctggtacccacaaaccagtgggtggccagtcgtaacgggcaactctgcagcggaaccgactactttgggtgtccgtgtttcattttattcctatactggctgcttatggtgacaattgaaagattgttgccatatagctattggattggccatccggtgacaaataaagcgattgtttatcagttcattggtttcgtaccgctaaactacacaacattaaacaccctcaactttatcctattgctcaacacaacaag

SEQ ID NO: 916 - DNA, 726 bp, Coxsackievirus
  A6 gene for polyprotein, polyprotein region,strain1
gtacccaccctcagggcccactgggcgctagcactctgattctgcggaatccttgtgcgcctgttttataaccctcccccgattcgtaacttagaagcaatgagcctcactgatcaacagtaggcgcggcgcaccagccgtgtcttgatcaagcactcctgtttccccgggctgagtatcaatagactgcttgcgcggttgaaggagaaaacgctcgttacccggctaactacttcgagaaacctagtagcaccatcgaaattgcagagtgtttcgctcagcacttcccccgtgtagatcaggtcgatgagtcactgcaacccccacgggcgaccgtggcagtggctgcgttggcggcctgcctatggggcaacccataggacgctctaaaatggacatggtgtgaagagtctattgagctagttagtagtcctccggcccctgaatgcggctaatcctaactgcggagcgcatgcccccaaaccagagggtggtgcgtcgtaacgggcaactctgcagcggaaccgactactttgggtgtccgtgtttccttttattcttactatggctgcttatggtgacaattgaagaattgttaccatatagctattggattggccatccggtgtctaatagagctattgtatatttatttgttggatttgttccattgacatatacatcacttaatacattaaacttcattgtgagattaaacacaagaaa

SEQ ID NO: 917 - DNA, 726 bp, Enterovirus sp.
  C96, strain XZ94-XZ-CHN-2012, complete genome.1
ttaaaacagctctggggttgttcccaccccagaggcccacgtggcggccagtacaccggtatcacggtacccttgtacgcctgttttatactccctaccccgtaacttagaagcattgactcaagttcaatagtaggggtacaaaccagtaccaccacgaacaagcacttctgtttccccggtgatgtcgtatagactgtacccacggttgaaagtgacagatccgttacccgcttttgtacttcgagaagcccagtaccaccttggaatcttcgatgcgttgcgctcagcactcaatcccagagtgtagcttaggtcgatgagtctggacgttcctcaccggcgacggtggtccaggctgcgttggcggcctacctgtggcccaaagccacaggacgctagttgtgaacaaggtgtgaagagcctattgagctacaaaagagtcctccggcccctgaatgcggctaatcctaaccacggagcaggtgatcacaagccagtgattagcctgtcgtaatgcgcaagtctgtggcggaaccgactactttgggtgtccgtgtttccttttatttcatttatggctgcttatggtgacaatcatagattgttgtcataaagcgaattggattggccatccggtgagagtttagcgctttatttgtctgctcatcgaacttgcacttttgaattcttaccccttgcaccttattagacagtggtatcatc

SEQ ID NO: 918 - DNA, 726 bp, Enterovirus sp.
  C96, isolate SZ/GD/CHN/2015, complete genome.1
gttcccaccccagaggcccacgtggcggccagtacaccggtattacggtacccttgtacgcctgttttatactccctaccccgtaacttagaagcaaaaactcaagttcaatagcaggggggtacaaaccagtaccaccacgaacaagcacttctgtttccccggtgacttcgcataaactgtacccacggttgaaagcgatagatccgttatccgcttttgtacttcgagaagcctagtaccatcttggaatcttcgatgcgttgcgatcagcactcaaacccagagtgtagcttaggtcgatgagtctggacgatcctcaccggcgacggtggtccaggctgcgttggcggcctacctgtggtccaaagccacaggacgctagttgtgaacaaggtgtgaagagcctattgagctacaaaagagtcctccggcccctgaatgcggctaatcccaaccacggagcaggcgatcacaacccagtgactagcctgtcgtaatgcgcaagtctgtggcggaaccgactactttgggtgtccgtgtttctctttattccattaatggctgcttatggtgacaatcatagattgttatcataaagcgattcggattggccatccagtgaaaatcaagtgtactactcacttatttattgagtttacaactctaacccatcactcactacaacccattttattgtgtcactatccagacagtggtatcatc

SEQ ID NO: 919 - DNA, 726 bp, Echovirus
  E7, strain HAI/2016-23084 polyprotein gene, complete cds.1
ttcccacccacaaggcccaccgggcgttggcacactggtatcacggtacctttgtgcgcctgttttaaaacccctacccccaaacgcaacttagaagataagcacacagtccaatagagggcgtggcactccagccatgtcttggacaggcactcctgttaccccggactaagtaccaataaactgctcacgcggttgaaggggaaaacgttcgttatccggctaactacttcgaggaacctagtaacaccgtgaaagttgcagagtgtttcgctcagcacaaccccagtgtagatcaggtcgatgagtcaccacgttccccacgggcgaccgtggtggtggctgcgctggcggcctgcctatgggtcaacccataggacgctctaacacagacacggtgtgaagagtcgattgagctagttagtagtcctccggcccctgaatgcggctaatcctaactgcggagcgtgcgtccccaaaccaggagatagcgcgtcgtaacgggcaactctgcagcggaaccgactactttgggtgtccgtgtttccttttttttacctctatttggctgcttatggtgacaattgaagaattgttaccatatagctattggattggccatccggtgactaatagagctattgtttacctctttgttggttttgtaccactgaacctcatagttctaaatacccttaatttgattttagtgcttaacacatcaaa

SEQ ID NO: 920 - DNA, 727 bp, Human enterovirus 70
  strain J670/71, complete genome.1
ttaaaacagctctggggttgttcccaccccagaggcccacgtggcggctagtactccggtaccccggtacccttgtacgcctgttttatactccctttcccaagtaactttagaagaaataaactaatgttcaacaggagggggtacaaaccagtaccaccacgaacacacacttctgtttccccggtgaagttgcatagactgtacccacggttgaaagcgatgaatccgttacccgcttaggtacttcgagaagcctagtatcatcttggaatcttcgatgcgttgcgatcagcactctaccccgagtgtagcttgggtcgatgagtctggacaccccacaccggcgacggtggtccaggctgcgttggcggcctacccatggctagcaccatgggacgctagttgtgaacaaggtgcgaagagcctattgagctacctgagagtcctccggcccctgaatgcggctaatcccaaccacggagcaaatgctcacaatccagtgagtggtttgtcgtaatgcgcaagtctgtggcggaaccgactactttgggcgtccgtgtttccttttatttttattatggctgcttatggtgacaatctgagattgttatcatatagctattggattagccatccggtgatatcttgaaattttgccataactttttcacaaatcctacaacattacactacactttctcttgaataattgagacaactcata

SEQ ID NO: 921 - DNA, 728 bp, Enterovirus sp.
  D, isolate EV-D111_CAF-BAN-06-150 polyprotein gene,1
ttcccaccctagaggcccacgtggcggctagtactctggtattacggtacctttgtacgcctgttttatatccctttccccattgtaacttagaagtttcaaagtacagttcaatagacagtagtacaaaccagtactgctacgaacaagcacttctgttgccccggtgtagttgcatagactgtacccacggttgaaagcaactgatccgttatccgctttagtacttcgagaagcctagtagcaccttgggatcttcgatgcgttgcgctcagcactcaaccccagagtgtagcttgggtcgatgagtctggacattcctcaccggcgacggtggtccaggctgcgttggcggcctacctgtggcccaaagccacaggacgctagttgtgaacaaggtgtgaagagcctattgagctactaaagagtcctccggcccctgaatgcggctaatcctaaccacggagcaagtgctcacagtccagtgagtagcttgtcgtaatgagcaattctgtggcggaaccgactactttgggtgtccgtgtttccttttatttttatcattggctgcttatggtgacaatctaaggttgccatcatatagcttttggattggccatcccggtgatatttcgaattattcaatttgctgtttgcagctccttttaaacagtattcactcaccagcattcatattttactcttgagttattaacaaatagtcaaaa

SEQ ID NO: 922 - DNA, 729 bp, Bovine kobuvirus
  strain SC1 polyprotein gene, complete cds.1
attcccaaggcccactcggttcaacttcggtttccggacaaatataaagaacctcagtcctcttggtactttctcgcctgagtcaacaaagcgagaaacctgcccctccagcgccagacgagcggcataaaacttgaacttctggcatgctccaccacccttttccccattccaacccccattgcgctctcaaggtcgcgctttttcgagactagctcggattcaaaagttcctggcaccctttgccccttcaggcccttaaggtaggaactgaccttgtgctgtgccctcggtgcggaagtgctactgcgtagcgattgtaagatccctttgtggttctgccctggcaaggttatagagtactgtgatccgctgcggatgccatcctggtaacaggacccccagtgtgcgcaacagtatgttcacggtcttccgtgtccaccacattcggaacactgctctcgtgaaacagtgtgtgtccaatccctgcaatcagtatcaactacaccacctaggaatgctaggaaggtaccccggtccgccgggatctgatcctaggctaattgtctacggtggtgctcctttttattttccacttcaattcattggttacaactgctcgatccctgtgtttgctgcccttctctgctctcatcgccattctcaagtgttcacactgtccaagttcctttggttgttcgcttccacttgccactgtcaactcttgtc

SEQ ID NO: 923 - DNA, 729 bp, Coxsackievirus
  A10, strain 17-118-2, complete genome.1
gttgcacccacccacagggcccaccgggcgctagcactctgattttacgaaatctttgtgcgcctgttttatatccccttccctattcgtaacttagaagtaatgagcaacaacgatcaatagcaggcgtggcgcaccagccatgtcttgatcaagcacttctgttaccccggactgagtatcaatagactgctcacgcggttgaaggagaaaacgttcgttacccggctaaccacttcggaaaacctagtagcaccattgaagctgcagagtgtttcgctcagcacttcccccgtgtagatcaggtcgatgagtcactgcaacccccacgggcgaccgtggcagtggctgcgttggcggcctgcctatggggtaacccataggacgctctaatgtggacatggtgtgaagagtctactgagctggttagtagtcctccggcccctgaatgcggctaatcctaactgtggagcgcacactctcaaaccagggagcagtgcgtcgtaacgggcaactccgcagcggaaccgactactttgggtgtccgtgtttccttttatccttatattggctgcttatggtgacaatcacggaattgttgccatatagctattggattggccatccggtgtctaatagagctattgtgtacctatttgttggatttactccactgtcatataaatctctgaacactttgtgctttatattgaacttaaacacacgaaa

SEQ ID NO: 924 - DNA, 729 bp, Human poliovirus 3
  isolate Env08_E2886 polyprotein gene, complete1
ttaaaaacagctctggggttgttcccaccccagaggcccacgtggcggctagtactctggtattacggtacctttgtacgcctgttttatatcccctttcccctgtaactcagaagcatgaagtttaagctcaacaggaggggtgcaaaccagcacctctacgagcaagcactactgtttccccggtgaagttacatagactgttcccacggttgaaagtgattgatccgttatccgctcatgtacttcgagaagcctagtatcgctctggaatcttcgatgcgttgcgctcaacactcgaccccggagtgtagcttaggccgatgagtctggacattccccactggcgacagtggtccaggctgcgttggcggcctacctgtggtccaaagccacaggacgctagttgtgaacagggtgtgaagagcctattgagctgcatgagagtcctccggcccctgaatgcggataatcctaaccatggagcaggcaactgcaacccagcagtcagcctgtcgtaacgcgtaagtccgtggcggaaccgactactttgggtgtccgtgtttccttttatttttgaatggctgcttatggtgacaatcacagattgttatcataaagcaaattggattggccatccagtgaatcactaccgagtttgttaaatctatttcagagacacacaactcctcaacgcactatacctaaacagaggattatactacagcg

SEQ ID NO: 925 - DNA, 729 bp, Coxsackievirus
  A9, strain USA/2015/CA-RGDS-1050, complete genome.1
catgctcccacccatagggcccactgggcgtcagcacactggtattgcggtacctttgtgcgcctgttttatccaccccaccccctcaacgtaacttagaagcacatcccacacggtcaatagttggctcgataagccaatcgagtctggatcaagcacttctgttaccccggactgagtatcagtaagctgcttgcgcggctgatggagaaaacgttcgttacccggccatttacttcgggaaacctagtaccaccatgaatgttgcgcagcgtttcgctccacactaccccagtgtagatcaggtcgatgagtcactgcataccccacgggcgaccgtggcagtggctgcgctggcggcctgcccatggggcaacccatgggacgcttcaatactgacatggtgcgaagagtctactgagctaagtggtagtcctccggcccctgaatgcggctaatcctaactgcggagcagatacccacgaaccagtgggcagtctgtcgtaatgggcaactctgcagcggaaccgactactttgggtgtccgtgtttccttttattctaatactggctgcttatggtgacaattgaacgattgttaccatatagctattggattggccatccggtgacaaacagagcgattatatactcatttgttgggttcgtaccacttaattacaaagttctaaacacccttaactatatactagcactcaacacatcaaa

SEQ ID NO: 926 - DNA, 730 bp, Hedgehog hepatovirus
  isolate Igel68Erieur2014 polyprotein gene,1
ttcaaaggcggtgtcccggattgtttccgggccgcctttgggcaaccatgatgaggggttgtaaatcacctcatccccgtttgcctagggtgataggctttttatgttttatgtttgttggtctagttcgtcaattgtaaatattgatttctgcaggttcagagttcttaattatgttcctctataaggacactctctttaagtctaggccataagtgatcctagagataggtgaacctttcatatctggtctatgttagggcctttatatccctaggggcaatctttgtgccccttatttctcctatctttcttcttttcttccgggctctcacggtgccaatggaacgaccggtgcgcccgccggggttaactccaagattagcttggagctgtagttgctaaaagccgtgatgaaggaagcagactatcaagttagttaggtgttaactgaaacatgaattctattatgatctttgtgagtgggtaggctacgggtgaaacccactaggttaatactcatattgagagatacctccattaggctaaggttggcggtaaaggtgagtttaacgacgtatcctttcaacgcctgtgggccggtctcaatggcacaatgcgtagtagatgaagtgtgtagggcctactaaggagatgctctgtggaattcaccctcccgaaaggtcgtaggggtactcaggggcatttaggtttccacattttaaatttc

SEQ ID NO: 927 - DNA, 730 bp, Simian enterovirus 46
  strain RNM5, complete genome.1
tttaaaacagcctgtgggttgtacccactcacagggcccacgtggcgttagtactctggtatcacggtacctttgtatgcctgttttatctcccttcccccgtaacgttagaagaataaacaaatgacaactagcaaatccaccaacccaggtgggttttcgtcaagcacttctgtttccccggacttagtaccaataggctgtacccacggctgaaggggaaaatgttcgttacccggctacctacttcgaaaagcctagtaccaccaatgattgtctcaagtgttacgttcagcacaaccccagtgtagttcaggccgatgagtcaccgaattccccacgggcgaccgtgtcggtggctgcgttggcggcctgcctgcgggtttcacccgcaggacgcttgattcatgacatggtgcgaagagcctattgagctaggtagtagtcctccggcccctgaatgcggctaatcctaaccacggagcattcactggcaaaccagccagcagaatgtcgtaatgggtaactctgtggcggaaccgactactttgggtgtccgtgtttcctgttttacttattttggctgcttatggtgacaatttacggattgttaccatatagctattggattggccatccggattattgcaatactactatttgtgggatttctccctttgtgttataataactaccccattctaacattagctctcaagtttaatacact

SEQ ID NO: 928 - DNA, 730 bp, Coxsackievirus
  A2, strain 63041-775 polyprotein gene, complete cds.1
tgcacccacccacggggcccactgggcgccagcactctgattctacggaatccttgtgcgcctgttttataaccccccccctcaattaggtaacatagaagttagaaacatatatggccaatagcaggcgtggcgcaccagtcgcgtctcggtcaagcacttctgtttccccggactgagtatcaataagctgctcgcgcggctgaaggagaaaacgttcgttatccggctaactacttcgagaaacctagtagcaccatgaaagttgcggagtgtttcgctcagcacttcccccgtgtagatcaggtcgatgagtcactgcattccccacgggcgaccgtggcagtggctgcgttggcggcctgcctatggggtaacccataggacgctctaatacggacatggtgcgaagagtcaattgagctagttagtagtcctccggcccctgaatgcggctaatcctaactgcggagcacataccctcaatccagggggcggtgtgtcgtaatgggcaactctgcagcggaaccgactactttgggtgtccgtgtttccttttattcttatattggctgcttatggtgacaattgagagattgttaccatatagctattggattggccatccggtgtccaacagagctctggtttacttgttcgttggctttatacctctgtcacccacagtttattcaactctagtgttcttaatacgccttaacagtaagag

SEQ ID NO: 929 - DNA, 730 bp, Coxsackievirus
  A10, strain 61216-2814 polyprotein gene, complete1
gttgcacccacctacagggcctactgggtgctagcactctgattctacggaatctttgtgcgcctgttttataaccccctccccaatttgtaacttagaagcaatgaaccccatcgatcaatagcaggcataacgcaccagttatgtctcgatcaagcacttctgttttcccggactgagtatcaatagactgcttgcgcggtcgaaggagaaaacgttcgttacccggctaactacctcgagaagcctagtagcaccactgaaactgcagagtgtttcgttcaacacttcccccgtgtagatcaggtcgatgagtcactgctctccccacgggtgaccgtggcagtggctgcgttggcggcctgcctatggggtaacccataggacgctctgaagtggacatggtgtgaagagcctattgagctagttagtagtcctccggcccctgaatgcggctaatcctaactgtggagcgcatgccctcaaaccagggggtggtgcgtcgtaacgggtaactccgcagcggaaccgactactttgggtgtccgtgtttccttttattatcctattggctgcttatggtgacaattaaagaattgttaccatatagctattggattggccatccggtgtgtaatagagcgattatctacctatttgttggatacattccgttaacattcaaatctctcaacacattatactacattctgaccttgaacacaagaaa

SEQ ID NO: 930 - DNA, 730 bp, Enterovirus C
  strain EQG1419332, complete genome.1
ggggttgttcccaccccagaggcccacgtggcggctagtacactggtatcacggtacctttgtacgcctgttttatactccttcccccgcaatttagaagcatacaattcaagctcaataggagggggtgcaagccagcgcctccgtgggcaagcactactgtttccccggtgaggccacatagactgttcccacggttgaaagtgtccgatccgttatccgctcatgtacttcgagaagcctagtatcgctctggaatcttcgacgcgttgcgctccacactcagtcccagagtgtagcttaggctgatgagtctggacattcctcaccggcgacggtggtccaggctgcgttggcggcctacctgtggcccaaagccacaggacgctagatgtgaacaaggtgtgaagagcctattgagctataagagagtcctccggcccctgaatgcggctaatcccaaccatggagcaggcagccgcaatccagcagccagcctgtcgtaacgcgcaagtctgtggcggaaccgactactttgggtgaccgtgtttccttttattatttcaatggctgcttatggtgacaatcatagattgttatcataaagcgagttggattggccatccagtgtgaatcggattatttactcccttgtttgttggattcactcccgaaacgttttaccccttaacttattgaaattgtttgaagacaggatttcagtgtcaca

SEQ ID NO: 931 - DNA, 731 bp, Salivirus A
  strain YZ01, complete genome.1
gtgtttctcccccctttcgaccgccctatggcaggcgggcttgtggacggcttcggcccacccacagcaagaatgccatcatctgtcctcacccccatcttcccctttcttcccctgcaaccgtcacgcttactcacatgtgcattgagtggtgcacgtgttgaacaaacagctacactcacatggggcgggttttcccgccttgcggcctctcgcgaggcccacccctccctctcctcccataactacagtgctttggtaggtaagcatcctgatcccccgcggaagctgctcacgtggcaactgtggggacccagacaggttatcaaaggcacccggtctttccgccttcaggagtatccctgctagtgaattctagtagggctctgcttggtgccaacctcccccaaatgcgcgctgcaggagtgctcttccccaactcaccctagtatcctctcatgtgtgtgcttggtcagcatatctgagacgatgttccgctgtcccagaccagtccagtaatggacgggccagtgtgcgtagtcgtcttccggcttgcccggcgcatgtttggtgaaccggtggggtaaggttggtgtgcccaacgcccgtactttggtgatacctcaagaccacccaggaatgccagggaggtaccccgcttcacagcgggatctgaccctgggctaattgtctacggtggttcttcttgcttccacttctttctactgttt

SEQ ID NO: 932 - DNA, 731 bp, Enterovirus sp.
  isolate CPML_3961/08, complete genome.1
ttaaaatagcctgagggttgctcccacccacggggtccacgtgacgtagtactctggtatctcggtacctttgtacgcctattttatatccccttccccctttgtaacttagaagaaataagcaaactgcccaatagcggcacaatacccaattgtgttacgggcaagcactcctgtttccccggaagggtctatcggtatgctgtacccacggcagaagtatgacctaccgttaaccggccatgtacttcgagaagcctagtaccaccatgaaggttgattgatgttacgttccccagcaaccccagctggtagttctggtcgatgagtctcggcatcccccacgggcgaccgtggccgaggctgcgctggcggccagcctacacctctttggtgtaggacgtcaagatattgacatggtgtgaagagcctattgagctacgtggtagtcctccggcccctgaatgcggctaatcctaactccggatcgtccgctggcaatcccgccagaagggcgtcgtaatgcgcaagtctggagcggaaccgactactttgggtgtccgtgtttcctgttttatttactgtttggctgcttatggtgacaacttatagttatcatcataagctacttggtcttgccaaccggagaataatttggttatttgttggttttacaaacctacaagagtcagtactcatcctattaattgttctaagaataaacacacaag

SEQ ID NO: 933 - DNA, 732 bp, Bovine hungarovirus 1
  strain BHUV1/2008/HUN, complete genome.1
tcgcccctcctttccccccttattttcccttttccctctctccctccctttgtaacttaacgtttggcaagaaccctcacctgtcaattgggaccaccactttcagtgaccccatgcgaagtagtgagagagaataagctttcttacccttcatttgtgaacccttcagtcgaagccgcttggaataagataggaggaaaagttcattctaaatggagtgaaacatgtacttcagaatttctagcacgcgctgggctttcttgcgtgtgacggcactgtcttgccggagctctccacactgacaccccacgcttgtggaccttggtggcagatgacaacactgcagctggaattgagtgtctggtacactctgtgtaacagtgaaaacaatgtgatcacttcggtgagctagtagcctgtggaccaacaactggtaacagttgcctcaggggccaaaagccacggtgtttacagcaccctactggtttgattggagcaatccaagatgtcacagagttagtaattgccaagcagtccgtactggtatcttgacataccgtgcagttttggatagtgaaggatgccctgacggtacccataggtaacaagtgacactatggatctaagcaggggctcactctacgctgctttacagctggctgtgagttaaaaaacgtctagctatccacaacctaggggactaggttttccttttatttagattacaattat

SEQ ID NO: 934 - DNA, 732 bp, Human poliovirus 2
  strain NIE0811454, complete genome.1
ttaaaacagctctggggttgttcccaccccagaggcccacgtggcggctagtacaccggtattgcggtacccttgtacgcctgttttatactcccttttccctgtaacttagaagaaacaaaccaagttcaatagaagggggtacaaaccagtaccaccacgaacaagcacttctgtttccccggtgatgttgcatagactgtacccacggttgaaagcgattgatccgttacccgctcttgtacttcgagaagcctagtatcatcttggaatcttcgatgcgttgcgctcagcactcaaccccagagtgtagcttaggtcgatgagtctggacattcctcaccggcgacggtggtccaggctgcgttggcggcctacctgtggcccaaagccacaggacgctagttttgaacaaggtgtgaagagcctattgagctacatgagagtcctccggcccctgaatgcggctaatcccaaccacggagcaagggtgcacatgccagtgtataccttgtcgtaacgcgcaagtctgtggcggaaccgactactttgggtgtccgtgtttccttttatttttacattggctgcttatggtgacaatcgaagattgttatcataaagcgagttggattggccatccggtgaaagtaaagcatattatttacttggttgttgggattataccactcaatccttttactaacaatacgaggataaaacaacaatactaca

SEQ ID NO: 935 - DNA, 732 bp, Human echovirus
  32, strain PR-10 complete genome.1
tgtgggttgttcccacccacagggcccactgggcgctagtacactggtaccaaggtacctttgtacgcctgttttataccccctccccgatccgaaacttagaagtaaagcaaacccgatcaatagtaggtgcgacactccagtcgtatctcgatcaagcacttctgtttccccggactgagtatcaatagactgcccacgcggttgaaggagaaaacgtccgtcatccggctaactacttcgagaaacccagtagcaccatggaagttgcagagtgtttcgctcagcactaaccccgtgtagatcaggctgatgagtcaccgcattccccacgggtgaccgtggcggtggctgcgttggcggcctgcctatggggcaacccataggacgctctaatacggacatggtgtgaagagtctattgagctagttagtaatcctccggcccctgaatgcggctaatcctaactgcggagcacatactcctactccaaggagcagtgtgtcgtaacgggcaactctgcagcggaaccgactactttgggtgtccgtgtttcctattaacatatcactggctgcttatggtgacaattgaaagattgttaccatatagctattggattggccatccggtgtcaaacagagcaatagtgtacctattcgctgggtttatcccattgactgttaaagatatacaaactctctacttgataatacaactaaacactgtaaa

SEQ ID NO: 936 - DNA, 732 bp, Enterovirus sp.
  B, isolate BG/521_2017/CSF/2017 polyprotein gene,1
ctgtgggttgttcccactcacagggcccactgggcgttagcacactggtattgcggtacctttgtgcgcctgttttatccaccctttccccatagtaacttagaagtacgttcaaatggtcaataggcggctcagtataccaactgagtctcgaccaagcacttctgttaccccggaccgagtatcaataagctactcacgtggctgaaggagaaaacgttcgttacccggccaactacttcgagaaacctagtaccaccatggatgttgcgcggcgtttcgctccgcactaccccagtgtagatcaggtcgatgagtcaccgcattcctcacgggcgaccgtggtggtggctgcgctggcggcctgcccatggggcaacccatgggacgcttcaatacagacatggtgtgaagagtctattgagctagttggtagtcctccggcccctgaatgcggctaatcctaactgcggagcagatccccacacaccagtgggcagtctgtcgtaatgggtaactctgcagcggaaccgactactttgggtgtccgtgtttccttttattcttatactggctgcttatggtgacaattgaaagattgttaccatatagctattggattggccatccagtgtctaacagagcaataatctatctttttgttggattcgtcccacttgactacagagcacttgcaacgctcaattacattatagatctcaacacaacgaa

SEQ ID NO: 937 - DNA, 733 bp, Enterovirus sp.
  A, isolate E0-67 polyprotein gene, partial cds.1
cttgtacccactcacagggcccactgggcgctagcactctgattccacggaatctttgtgcgcctgttttataaccccttccccaacttgaaacgtagaagcaatacacataaccgatcaatagcaggcgtgacgcaccagtctcgtctcgatcaagcacttctgtttccccggaccgagtaacaatagactgctaacgcggttgaaggtgaaaacgttcgttatccggctaactacttcgagaagcccagtaacactatgaaagctgcggagcgttacgttcagcactcccccccgtgtagttcaggccgatgagtcactgcgatccctacgggcgaccgtagcagtggctgcgctggcggcctgcctatggggcaacccataggacgctctaaagtggacatggtgcgaagagctaattgagctagttagtagtcctccggcccctgaatgcggctaatcctaactgcggagcgcacgcctccaacccagggggtggtgcgtcgtaacgggcaactctgcagcggaaccgactactttgggtgtccgtgtttccttttattcttatattggctgcttatggtgacaatcacagagttgttaccatatagctattggattggccatccggtgtgcaacagagctatcatttatctatttataggttttgtaccattaactttgagatctacgaccaccctagagtacatattggttttaaattcaattagac

SEQ ID NO: 938 - DNA, 733 bp, Human enterovirus sp.
  79, strain 17-2255-1_E79, complete genome.1
ctgtgggttgttcccacccacagggcccactgggcgccagcactctgattccacggaatctttgtgcgcctgttttacaaccctccccaatttgtaacgtagaagcaatacacactactgatcaatagtaggcatggcgcgccagtcatgtcatgatcaagcacttctgttccccggactgagtatcaatagactgctcacgcggttgaaggagaaaacgttcgttacccggctaactacttcaagaaacctagtagcaccatggaagctgcggagtgtttcgctcagcacttcccccgtgtagatcaggtcgatgagtcactgcaatccccacgggcgaccgtggcagtggctgcgttggcggcctgcctatggggtaacccataggacgctctaatgtggacatggtgcgaagagtctattgagctagttagtagtcctccggcccctgaatgcggctaatcctaactgcggagcacatgccttcaacccaggaggtggtgtgtcgtaacgggtaactctgcagcggaaccgactactttgggtgtccgtgtttccttttatccttatattggctgcttatggtgacaatcacggaattgttgccatatagctattggattggccatccggtgtctaacagagctattgtatacctatttgttggatttgtaccactaaattacaaggttttaaacactctcaaccttataatactactcaactcagcaaa

SEQ ID NO: 939 - DNA, 733 bp, Enterovirus sp.
  D68, strain USA/CA/2002-23233, complete genome.1
ttaaaacagccttggggttgttcccacctcaagggcccacgtggcggccagtactctggtatctcggtacctttgtacgcctgttttaattccctccccaacgtaacttagaagcttttaaaccaaagctcaataggcggagcgcaaaccagcgctcttatgagcaagcacttctgtctccccggtgtggttgtatagactgtccccacggttgaaaacaacttatccgttaaccgctatagtacttcgagaaacctagtattgccttcggagtgtcgatgcgttgcgctcagcacactaacccgtgtgtagcttgggtcgatgagtctggacgtaccccactggcgacagtggtccaggctgcgttggcggcctactcgtggtgaaaaccatgagacgctagacatgaacaaggtgtgaagagtctattgagctactatagagtcctccggcccctgaatgcggctaatcctaaccatggagcaagtgctcacaaaccagtgggttacttgtcgtaatgcgcaagtccgtggcggaaccgactactttgggtgtccgtgtttcactttttacttttatgactgctaatggtgacaatttaatattgttaccatttggcttgtcgaattgatcacataagatctatagttttgttcactgatttgctttcaaataatctcacctcaaaacctccagtacataacatttaaagagtttaaacttatttataaca

SEQ ID NO: 940 - DNA, 734 bp, Picornaviridae sp.
  isolate rfb199pic1 genomic sequence.1
ctccagcacatgtctattggtgcacttgagctgatccaagcaacggatgtacacacccggttcactaacactttcgcgacagctacccctcactgggaccggttcacaacaacgggccacggggttgcccccggtggtacggcacgtctggaataccggcaatgtgtaccacacactcaggtgagactgccactacttgagttagctactaggagtagccgcacccgccgaatgtcacaacccgcgcagttctgcattcccccgcacctggcggggagctggatggtgttgtaatgctcaccaccgctaatccgggaatcctaggactgacctgttgtgttttagacctcaagaagttaatcactacgagatcgcctagtgcccagttcgcgcgctggagcaggacccaccacggcctttgtgatgggggaatgcagaactgcgcgggttgtgacattcggcgggtgcggctactcctagtagctaactcaagtagtggcagtctcacctgagtgtgtggtacacattgccggtattccagacgtgccgtaccaccgggggcaaccccgtggcccgttgttgtgaaccggtcccagtgaggggtagctgtcgcgaaagtgttagtgaaccgggtgtgtacatccgttgcttggatcagctcaagtgcaccaatagacatgtgctggaggtacccgtaaggatctgaccagtagctaattagtccctgttggtgt

SEQ ID NO: 941 - DNA, 734 bp, Orivirus A
  strain chicken/Pf-CHK1/2013/HUN, complete genome.1
ttctctcccccctctgggccgccatccttggccagaaaccctcacgagtgcttgtggtaggtcccaggccaatattcttcgtaaggcttggttccaattttccaccactcgtgtttgggttctggcctatggtacccagaggggcggtttgggggaattaactccccctcccctgtggtcctataccaccccacacctctgtgggctttctttactatcttcttgttttccgacttttaaacactaggcaggcgcgcctagtcatacaccgcccggctggtctttccagctcttgtgggcggtgcgcgctggtccatcgtgcccagcgacatagcaccttgtggacacctccgaacgccctcccctgtatggggtggtgcccaggggtttcagtgtggtgacacactccctggggcccgaaaggctagtgtgcaacaggtgaggtacagccagctgcccccgtggctggagggaccaagcttgtgaagcacacctcaccttcttgggggtgggctagtaagtggtgaaagcatagtgtccgtgtcgctggccaacactttgggtcaagtccagccactcagtgagtagatgcccaggaggtacccctagtggatctgacttggggcctgttacttaatgcaggttaaaaactatgaaagctgagtagtgtagcccggctggtggcttctcttccttattcattctattttatggtgacaaacgcaactgaagcc

SEQ ID NO: 942 - DNA, 734 bp, Coxsackievirus
  A10, strain 09-1895-1, complete genome.1
gcctgtgggttgtacccacccacagggcccactgggcgctagcactctggcaccacggtacctttgtgcgcctgttttatcaccctaccccattcggaacttagaagcaatacacaaccgaccaatagtgggtgtggcacaccagccgcatcttggtcaagtacttctgtttccccgggttgagtatcaataagctgctcacacggctgaaggagaaaacacccgtcacccggccaactacttcgagaaacctagtaccactatgaatgttgcaaggcgtttcgctcagcacttcccccgtgtagatcaggtcgatgagtcaccgcattccccacgggcgaccgtggcggtggctgcgttggcggcctgcctatgggttaacccatgggacgccttaatactgacatggtgcgaagagtctattgagctagttggtagtcctccggcccctgaatgcggctaatcctaactgcggagcacatactcacaagccagtgagcggtgtgtcgtaacgggtaactctgcagcggaaccgactactttgggagtccgtgtttccttttatccttatattggctgcttatggtgacaattggagaattgttaccatatagctattggattggccatccggtgtctaatagagctattatatacctatttgttggatttactccactaacacacaaatccctaaacactttgtgctttatcttaaacttaaatacacgaaa

SEQ ID NO: 943 - DNA, 734 bp, Enterovirus sp.
  C99, isolate 3291/BRA-PA/10, complete genome.1
gggggttgttcccaccccagaggcccacgtggcggctagtactccggtatcacggtacccttgtacgcctgttttatacccccttcccccgtaacttagaagcaataatccaagttcaatagaagggggtacaaaccagtaccaccacgaacaagcacttctgttaccccggtgaagttgtatagactgtgcccacggttgaaagcgaccgatccgttatccgctcttgtacttcgagaagcccagtatcatcttggaatcttcgatgcgttgcgctcagcactcaaccccagagtgtagcttaggtcgatgagtctggacggtcctcaccggtgacggtggtccaggctgcgttggcggcctacctgtggtccaaagccacaggacgctagttgtgaacaaggtgtgaagagcctattgagctacatgagagtcctccggcccctgaatgcggctaatcctaaccacggagcaagtgctcacaacccagtgagtggcttgtcgtaacgagcaattctgtggcggaaccgactactttgggtgtccgtgtttcctttattttattatatggctgcttatggtgacaatcattgattgttatcataaagcgagttggattggccatccggtgaaagtaaagcacattatttatctttttgttggatttactccattgagtgtttttactccagacgtgattcgagcagtcttattgattagaagcatctgccaca

SEQ ID NO: 944 - DNA, 734 bp, Unknown
  Description of Unknown: Human coxsackievirus A15strain G9, complete genome.1 sequence
ttaaaacagctctggggttgttcccaccccagaggcccacgtggcggctagtacaccggtattacggtacccttgtacgcctgttttatactccctcccccccgtaacttagaagtacaaaactcaagttcaataggagggggtacaaaccagtaccaccacgaacgagcacttctgtctccccggtgaggttacatagactgtccccgcggttgaaagtaaccgatccgttatccgctcttgtccttcgagaagcccagtaccatcttggaatcttcgatgcgttgcgctcaacactcaaccccagagtgtagcttaggtcgatgagtctggacactccccaccggcgacggtggtccaggctgcgttggcggcctacctgtggcccaaagccacaggacgctagttgtgaacaaggtgtgaagagcctattgagctacaagagagtcctccggcccctgaatgcggctaatcccaaccacggagcaggtgacttcaagccagaagttggcctgtcgtaacgcgtaagtctgtggcggaaccgactactttgggtgtccgtgtttccctttattcttacaatggctgcttatggtgacaatcatagattgttatcataagccgaattggattggccatcgggtgagaatcagatcagttacttacctgtttgttggattcactccgttgacactttacatactaacccttgtcaatacacctgtattatcata

SEQ ID NO: 945 - DNA, 734 bp, Echovirus
  E7 clone V10B polyprotein gene, complete cds.1
gcctgtgggttgttcccacccacagggcccactgggcgttagcacactggtattccggtacctttgtgcgcctgttttatccaccctccccaatgtaacgtagaagctacgctcaaacggtcaacagatagtccagtaatccagctgggccacgaccaagcacttctgtttccccggacagagtaccaataagctgctcgcgcggctgaaggggaaaacgttcgttacccggccaattacttcgagaaacctagtaccgccatggacgttgcgcagcgtttcgctccacacaaccccagtgtagatcaggtcgatgagccaccgcattccccacgggcgaccgtggcggtggctgcgttggcggcctgcccatggggtaacccatgggacgcttcaatacagacatggtgcgaagagtctattgagctaattggtagtcctccggcccctgaatgcggctaatcctaactgcggagcaggtacccacaacccagtgggtcacctgtcgtaatgggcaactctgcagcggaaccgactactttgggtgtccgtgtttccttttaacctttacactggctgcttatggtgacaattgaaagattgttaccatatagctattggattggccatcctgtgagtaatagagcgattgtatacttatttgttggctttataccactcaatttgaaagctttacagacactgaattatattgtggcattaaacacagcaaa

SEQ ID NO: 946 - DNA, 734 bp, Echovirus
  E6, strain HAI/2016-23034 polyprotein gene, complete cds.1
cctgtgggttgtccccactcacagggcccactgggcgccagcacactggtatcaaggtacctttgtgcgcctgttttatagccccttccccgaatgtaacgtagaagctgaacccaagcggtcaacaggcggctcagaacaccatctgggtcttgaccaagcacttctgttaccccggactgagtatcaataagctgctcacgcggctgaaggagaaaatgttcgttatccggccaattacttcgagaaacctagtaccaccatgaaggttgcgcagtgtttcgctccgcacaatcccagtgtagatcaggtcgatgagtcaccgcgttcctcacgggcgaccgtggcggtggctgcgctggcggcctgcccatggggcaacccatgggacgcttcaatactgacatggtgcgaagagtcaattgagctaattggtagtcctccggcccctgaatgcggctaatcctaactgcggagcagatgcccaagctccagtgggtagtctgtcgtaacgggtaactctgcagcggaaccgactactttgggtgtccgtgtttccttttattcttacattggctgcttatggtgacaattgagaaattgttgccatatagctattggattggccatccggtgacgaatagagcaattgtgtatctttttgttggattcataccactagataatacaaacttcaaaaccttgtgttacatcattaggttaaacacagcaag

SEQ ID NO: 947 - DNA, 735 bp, Feline kobuvirus
  isolate FKV/18CC0503, complete genome.1
ggggggcctcggccccctcaccctcttttccggtggtctggtcccggaccaccgttactccattcagcttcttcggaacctgttcggaggaattaaacgggcacccactcacccccatctccccctgtaacttgaagtgtgtgctcgtgaccttgactcctgcgggcttcaccgacccgtccagtgaacaaactgctaggtgatttcttcccctcccctagcctggatgttccacatccaggtcttcttcccccagcccgacatgtcatgggctgtttggaatccccgcgaaagctgctaacgtggcaattgtgggtcccccttccaacaagacaccgagtctttctcccttaaggctagccccgtgtggtgaattccaccgggcaactagtggtgtcaatgcatgcctccgacctcggccgcggagtgctgccccccaagttgcgaaactgaccaaggattgtgctgcctggcaagcatagtctgaggagatgttccgctgtggttgccaaacctggtaacaggtgccccagtgcgcgtagtctccttccggttcgtccggctgtcctttggtaaagacacaatgtaaggggcgtgtgccaacgccctggaaagagtgaacttctactgccctaggaatgccacgcaggtacccctggtttcttaccagggatctgagcgtgggctaattgtctaacgggtagtttcatttccctcccttcttttgttgacatc

SEQ ID NO: 948 - DNA, 735 bp, Aichivirus A
  strain rat08/rAiA/HUN, complete genome.1
gggtgggggggtgtcggccccctcaccctcttttccggtggtctggacccggaccaccgttactccattcagcttcttcggaacctgttcggaggaattaaacgggcacccactttcctgtcctctccccttttctgtaactccaagtgtgtgctcgtaatcttgactcccgcggattgaccgctccgctggtgaacaaactgctaggtcatctcctccccacccttgggcgtccttccgggcgtccacaccctccccccagcctgacgtgtcacaggctgtacaaagaccccgcgaaagctgctaacgtggcaattgtgggtcccccctttgtaaaggaaccgagtctttctcccttaaggctagacccctgtgtgaattcacaggtggcaactagtggttccactgcatgctcccgacctcggccgcggagtgctgttccccaagtcgtaacactgaccttcacttatgtgcctggcaagcatatctgagaagatgttccgctgtggctgccaaacctggtaacaggtgccccagtgtgcgtagtcttcttccgtcttcggacggtaggtgttaggtaaagatgcggcgtaaggttcaagtgccaacgccctggaagggatgacccttctactgccctaggaatgccgcgcaggtaccccaggttcgcctgggatctgagcgcgggctaattgtctacgggtagtttcatttccctcttcttccactggcatc

SEQ ID NO: 949 - DNA, 735 bp, Echovirus
  E13, strain GHA:VOL:KRN/2017 polyprotein gene, complete1
cttgtgggttgttcccacccacaaggcccactgggcgctagcacactggtattacggtacccttgtgcgcctgttttattcaccccctccccctacgtaacttagaagcgatacctacatggtcaacaggtgccccagcataccagctgggtcatgaccaagcaattctgttaccccggactgagtatcaataagctgctcgcgcggctgaaggagaaaacgttcgttacccggccagttacttcgagaaacccagtaccaccatgaaggttgcgcagtgtttcgctccgcacaaccccagtgtagatcaggtcgatgagtcaccgcgttccccacgggtgaccgtggcggtggctgcgttggcggcctgcccatggggcaacccgtgggacgcttcaatactgacatggtgtgaagagtctattgagctaactggtagtcctccggcccctgaatgcggctaatcctaactgcggagcagatgcccacatgccagtgggtggtctgtcgtaacgggcaactctgcagcggaaccgactactttgggtgtccgtgtttccttttattcctaaactggctgcttatggtgacaattgagagattgttaccatatagctattggattggccatccggtgacgaacagagctatcatttatttatttgttggttttgtgccgttgaaccgcaaagttctacacaccatcaatttcatcctactgcttaactcgacaaa

SEQ ID NO: 950 - DNA, 735 bp, Coxsackievirus
  B2, strain 13-2380-2_B2, complete genome.1
agcctgtgggttgcacccacccacagggcccactgggcgccagcactctggtactgcggtacctttgtgcgcctgttttatcaccccaccccatccggaacgtagaagctagacttaaatggtcaatagacggcccagtatgccaattgggtctcgaccaagcactcctgtttccccgggtttagtatcaataagctgctcacgtggctgaaggagaaaacacccgttatccggccaactacttcgagaaacttagtaccgctatgaacgttgcaaggcgtttcgctcagcacttcccccgtgtagatcaggccgatgagtcaccgcattcctcacgggcgaccgtggcggtggctgcgctggcggcctgcctatgggcttgcccataggacgccttaatactgacatggtgcgaagagtctattgagctagttggtagtcctccggcccctgaatgcggctaatcctaactgcggagcacatactcacaaaccagtgagcagtgtgtcgtaacgggcaactctgcagcggaaccgactactttgggtgtccgtgtttccttttattcctacactggctgcttatggtgacaattaaagaattgttaccatatagctattggattggccatccggtgtctaacagagctattatatacttgtttgttggattcataccacttgattccaatagctataacaccctactttacatcgttcatttgaacacgagaaa

SEQ ID NO: 951 - DNA, 736 bp, Aichivirus A
  strain Wencheng-Rt386-2 polyprotein gene, complete1
gggtgggggggcctcggccccctcaccctcttttccggtggtctggacccggaccaccgttactccattcagcttcttcggaacctgttcggaggaattaaacgggcacccactttcctgtcctctccccctttctgcaactcaagtgtgtgctcgtaatcctgactcccacgggttgaccgccccgttggtgaacaaacagctaggtcattccctccctacccctgggcgccatttcagtggcgttcatatcctccccccagcctgacgtgtcacaggctgtgcaaagtccccgcgaaagctgctcacgtggcaattgtgggtcccccctttgtgaaggaaccgagtctttctcccttaaggctagacccctgtgtgaactcacaggtggcaactagtggttccactgcatgctcccgacctcggccgcggagtgctgttccccaagtcgtgacactgacctccacttatgtgcctggcaagcatatctgagaagatgttccgctgtggctgccaaacctggtaacaggtgccccagtgcgtgtagtcttcttccgtctccggacggtaagtgtgtggtaaagatgcggcgtaaggttcaagtgccaacgccctggaagggatgacccttctactgccctaggaatgccgcgcaggtaccccaggttcgcctgggatctgagcgcgggctaattgtctacgggtagtttcatttccctctcttttcactggcatc

SEQ ID NO: 952 - DNA, 736 bp, Coxsackievirus
  A24 clone V5B polyprotein gene, complete cds.1
cccactggaggatattcactatatcctccagtgtttcccactggaggatatggtactgcggtatcacggtacccttgtacgcctgttttatactccccttccctgcaacttagaagattgtgaaaacctgtgttcaataggaagggggtacaaaccagtaccaccacgaacaagcacttctgtttccccggtgaagttgtataaactgtatccacggttgaaaacgactgatccgttacccgctctagtacttcgagaagcctagtatcatcttggaatcatcgatgcgttgcgttcatcactcaaccccagagtgtagcttaggctgatgagtctggacaatcctcaccggtgacggtggtccaggctgcgttggcggcctacctgtggcccaaagccacaggacgctagatgtgaacaaggtgtgaagagcctattgagctactagagagtcctccggcccctgaatgcggctaatcccaaccacgaagcaagtgctcacaacccagtgagtagcttgtcgtaatgcgcaagtttgtggcggaaccgactactttgggtgtccgtgtttcctttttacttttgtatggctgcttatggtgacaatcattgattgttatcataaagcgaattggattggccatccggtgagagcgagcacaatcacttatttgttcgttggattcactcctttaacaaaattttattgttctcttaattagaaaacatcatcaca

SEQ ID NO: 953 - DNA, 736 bp, Coxsackievirus
  A21, strain NIV17-608-2, complete genome.1
ccggggttgttcccaccccggaggcccacgtggcggctagtactctggtaccacggtacccttgtacgcctgttttatatcccctccccacgcaactttagaagaaattcaccaagttcaatagggggggtacgaaccagtaccaccacgaacaagcacttctgtttccccggtgattttacataggctgtacccacggctgaaagtgaatgatccgttacccgcttgagtacttcgagaagcctagtaccaccttggaatctccgatgcgttgcgttcagcactctaacccgagtgtagcttaggctgatgagtctgggcgatccccaccggcgacggtggcccaggctgcgttggcggcctacccgtggctaacgctacgggacgctagttttgaacaaggtgtgaagagcctattgagctacccaagaatcctccggcccctgaatgcggctaatcccaaccatggagcaagtgccctcaagccagggggtggcttgtcgtaacgcgtaagtctgtggcggaaccgactactttgggtgtccgtgtttccttttatttcatatttggctgcttatggtgacaatcacagattgttatcataaagcgaattggattggccatccagtgaaatataagctcattgtttatctccttgttggatttgttctgttaggaaattcctcaataaagttgactcgggtaatcttagtgattagaagtcatcatttcaaca

SEQ ID NO: 954 - DNA, 736 bp, Echovirus
  E20, strain HAI/2016-23041B polyprotein gene, complete1
agcctgtgggttgttcccacccacagggcccaccgggcgctagcacactggtatcccggtacctttgtgcgcctgttttacacaccctcccccgatggcaacttagaagatttccacacacggtcaataggcggctcagtataccaactgggtcatgaccaagcacttctgttcccccggactgagtatcaataagctgctcacgtggctgaaggagaaaacgttcgttatccggccaattacttcgagaagcttagtaccaccatagaggttgcgcagtgtttcgctccgcacaaccccagtgtagatcaggtcgatgagtcaccgcactcctcacgggcgaccgtggcggtggctgcgctggcggcctgcccatggggcaacccatgggacgcttcaatactgacatggtgcgaagagcctattgagctaattggtattcctccggcccctgaatgcggctaatcctaactgcggagcagatacccacgagccagtgggcagtctgtcgtaatgggtaactctgcagcggaaccgactactttgggtgtccgtgtttccttttattcctatattggctgctaatggtgacaattgagagattgttgccatatagctattggattggccatccggtgacaaacagagcgattatctatctatttgttggcttcataccattaaaccttagagtcctaaagaccctcaacttaattatacaatttaactctgcgaa

SEQ ID NO: 955 - DNA, 737 bp, Marmot kobuvirus
  strain HT9, complete genome.1
ggggcttcggccctcacaccctcttttccgatggtctggtcccggaccaccgtcactccattcagcttcttcggaacctgttcggaggaattaaacgggcaccccacttcccccccccaccctcgcaacttcaagtgtgtgtgcccataaccttgacccctgccggtatgccgcccggttcagtggacaaactgctaggcaaattcccccctccccctgtggctggtccttcaaccagccactctcttccccccagccggacgtgctacaggctgtgcaaagcccccgcgaaagctgctcacgtggcaattgtgggtcccccctttgtcaaggcttcgagtctttctcccttaaggctagtcccgtactgtgaaatcagtgtgggcaactagtgaagccactgcacgctcccgaccacggacgcggagtgctgtcccccaagtcatgacactaacaccaagctgtgctgcctggcaagcatagcctgggaaggtgttccgctgtggctgccaaacctggtaacaggtgccccagtgtgtgtaaccttcctccagtcttcggactggcagctttgtgtgaagacgtgacgtaaggttcaagtgccaactccctggaagggatgacccctctactgccctaggaatgctacgcaggtacccctggttcgccagggatctgagcgtaggctaattgtctacgggtagtttcatttcccacctttttatttctttagcatc

SEQ ID NO: 956 - DNA, 737 bp, Coxsackievirus
  A10 CV-A10/HVN11_028_Bac_GiangVNM/2011 genomic1
ccgatctgttgtacccacccacagggcccactgggcgctagcactccgattctgcggaatctttgtgcgcctgttttatgaccctcccccgaaacttgtaacttagaagttatgtacatcaccgatcaatagcaggcgtggcgcaccagccatgtcttgatcaagcacttctgtacccccggactgagtatcaatagactgctcacgcggttgaaggagaaaatgttcgttacccggctaactacttcgagaaacctagtaacaccattgaaactgcggagtgtttcgctcagcattccccccatgtagatcaggtcgatgagtcactgcttaccccacgggcgaccgtggcagtggctgcgttggcggcctgcctatggggcaacccataggacgctctaaagtggacatggtgcgaagagtctattgagctagttagtagtcctccggcccctgaatgcggctaatcctaactgcggagcgcatgtcctcaaaccagagggtggtgcgtcgtaatgggtaactctgcagcggaaccgactactttgggtgtccgtgtttcttttgttcttaaaatggctgcttatggtgacaatcgaggaattgttaccatatagctattggattggccatccggtgtgcaacagagctattatctacttgtttgtcggatacatccccttaacacctaaatcctttaatacattgcattatattttaacattgaacgcgagaaa

SEQ ID NO: 957 - DNA, 737 bp, Enterovirus sp.
  C99, isolate 3944/BRA-PA/11, complete genome.1
ctgggggttgttcccaccccagaggcccacgtggcggctagtactccggtattacggtacccttgtacgcctgttttatactccctttccccgtaacttagaagcaacaatccaagttcaatagaagggggtacaaaccagtaccaccacgaacaagcacttctgtttccccggtgaagttgcatagactgtacccacggttgaaagcgactgatccgttatccgctcttgtacttcgagaagcctagtatcactttggaatcttcgatgcgttgcgctcagcacccaaccccggggtgtagcttaggtcgatgagtctggacgttcctcaccggcgacggtggtccaggctgcgttggcggcctacctgtggcccaaagccacaggacgctagttgtgaacaaggtgtgaagagcctattgagctacatgagattcctccggcccctgaatgcggctaatcccaaccacggagcaaatgcccacaacccagtgggtggtttgtcgtaacgagcaattctgtggcggaaccgactactttgggtgtccgtgtttccctttttattattatgtggctgcttatggtgacaatcattggttgttatcataaagcgaattggattggccatccggtaagagtaaaacatatcatttacctttttgttggatttactccattgagtgttttcaccccagacgtaattcgtgtggttctgctgattagaagtttctatcaca

SEQ ID NO: 958 - DNA, 737 bp, Enterovirus sp.
  J, strain N125, complete genome.1
ttaaaatagcctcagggttgttcccaccctgagggcccacgtggcgtagtactctggtattacggtacctttgtacgcctattttacccccttccccttgtaacttagaagcaaagcaaaccagttcaatagtaagcaacacaacccagtgttgtgacgaacaagtacttctgtttccccgggagggtctgacggtaagctgtacccacggctgaagtatgacctaccgttaaccggctacctacttcgagaagtctagtaataccattgaagttttgttggcgttacgctcaacacactaccccgtgtgtagttttggctgatgagtcacggcattccccacgggcgaccgtggccgtggctgcgttgcggccaaccaaggggcgcaagctccttggacgtcacttaacagacatggtgtgaagaacctattgagctaggtagtagtcctccggcccctgaatgcggctaatcctaactccggagcacatcagtgcaacccagcatttggtgtgttgtaatacgcaagtctggagcggaaccgactactttgggtgtccgtgtttcctgttttaccttatttggctgcttatggtgacaatttgatattgttaccatatagctgttggattggccatccggatttttgaaagagacccaaaactttcttctctacttcagattcaagtgcgaagttttccttttcatatattacttactaatttgaagtaccaaag

SEQ ID NO: 959 - DNA, 737 bp, Enterovirus sp.
  J, strain N203, complete genome.1
ttaaaatagcctcagggttgttcccaccctgagggcccacgtggtgtagtactctggtattacggtacctttgtacgcctattttatacccccttccccaagtaatttagaagcaagcacaaaccagttcagtagtaagcagtacaatccagtactgtaatgaacaagtacttctgttaccccggaagggtctatcggtaagctgtacccacggctgaagaatgacctaccgttaaccggctacctacttcgagaagcctagtaatgccgttgaagttttattgacgttacgctcagcacactaccccgtgtgtagttttggctgatgagtcacggcactccccacgggcgaccgtggccgtggctgcgttggcggccaaccaaggagtgcaagctccttggacgtcatattacagacatggtgtgaagagcctattgagctaggtggtagtcctccggcccctgaatgcggctaatcctaactccggagcatatcggtgcgaaccagcacttggtgtgttgtaatacgtaagtctggagcggaaccgactactttgggtgtccgtgtttcctgttttaacttttatggctgcttatggtgacaatttaacattgttaccatatagctgttgggttggccatccggattttgttataaaaccatttcctcgtgccttgacctttaacacatttgtgaacttctttaaatcccttttattagtccttaaatactaaga

SEQ ID NO: 960 - DNA, 738 bp, Human poliovirus 1
  isolate P1W/Bar65 (19276), complete genome.1
ttaaaacagctctggggttgttcccaccccggaggcccacgtggcggctagtactctggtatcacggtacccttgtacgcctgttttatactcccctccccgtaatttagaagttcaaaacttaagttcaatagaagggggtacaaaccagtaccaccacgaacaagcacttctgtttccccggtgaggttgcatagactgtacccacggttgaaggcgactgatccgttatccgctcttgtacttcgggaagcccagtatcatcttcggatcttcgatgcgttgcgctcagcactcaaccccagagtgtagcttaggctgatgagtctggacaatcctcactggtgacagtggtccaggctgcgttggcggcctacctgtggcccaaagccacaggacgctagatgtgaacaaggtgtgaagagcccactgagctacaagagagtcctccggcccctgaatgcggctaatcccaaccacggagcaggtagttgcaaaccagcagccggcctgtcgtaacgcgcaagtctgtggcggaaccgactactttgggtgaccgtgtttccttttatcttttcaatggctgcttatggtgacaatcattgattgttatcataaagcgacttggattggccatccggtgaaatttaagtgcgtcagctatccatttattggatttaccccactaaaaccacatacgcctggccttagtgttgttggtgagacgctaccatcaaa

SEQ ID NO: 961 - DNA, 738 bp, Echovirus
  E18, isolate Jena/ST9524/10 polyprotein gene, complete1
cagcctgtgggttgtacccacccacagggcccacgtggcgctagcacactggtattccggtacctttgtgcgcctgttttatccaccccgtcccccactgtaacttagaagatatgcaaccctgatcaacagcaggtgtgacactccagtcacatcacgatcaagcacttctgttgccccggaccgagtatcaataagccactcgcgtggctgaaggagaaaacgttcgttatccgaccaactacttcgagaaacctagtaccaccctggaagttgcgtagcgtttcgctccacacaaccccagtgtagatcgggtcgatgagtcaccgcgttcctcacgggcgaccgtggcggtggctgcgttggcggcctgcccatggggcaacccatgggacgcttcaatactgacatggtgcgaagagtctattgagctagttggtggtcctccggcccctgaatgcggctaatcctaactgcggagcagatacccacatgccagtgggcgatctgtcgtaatgggtaactctgcagcggaaccgactactttgggtgtccgtgtttccttttattcttatattggctgcttatggtgacaattgagaagttgttaccatatagctattggattggccatccggtgacaaatagagcgattgtttatttgtttgttggatttataccactgaacttcaaggttttaaacaccctcaattttgtactagttcttaatacatcaaa

SEQ ID NO: 962 - DNA, 739 bp, Enterovirus sp.
  C, strain Saukett serotype 3, partial genome.1
acagctctggggttgtacccaccccagaggcccacgtggcggctagtactctggtgtcacggtacctttgtacgcctgttttataccccctcccccgtaacttagaagctataaaccaagttcaatagaagggggtacaagccagtaccaccacgaacaagtacttctgttaccccggtgacgttgtatagactgctcgcgcggtcgaaagcgacagatccgttacccgcttgtgtacttcgagaagtctagtaccaccttggaatcttcgatgcgttgcgctcagcactttaccccagagtgtagcttaggctgatgagtctgggcgctccccatcggcgacgatggcccaggctgcgttggcggcctacctatggctaacgccataggacgctagtagtgaacaaggtgtgaagaacctattgagctacacaagagtcctccggcccctgaatgcggctaatcctaaccatggagcaagtgatcacaatccagtgatattcttgtcgtaacgcgcaagtccgtggcggaaccgactactttgggtgtccgtgtttccctttatttttattatggctgcttatggtgacaatcattgattgttatcatagagcgaattggattggccatccggtgaaagtgaaactcattatctacttatttgttggattcactccatcaaacacattcacttatagtatcatcttgacagtgattagaattagacagtcgtatcaca

SEQ ID NO: 963 - DNA, 739 bp, Echovirus
  9 (strain Hill), complete genome.1
ttaaaacagcctgtgggttgtacccacccacagggcccactgggcgccagcactctggtatcgcggtacctttgtgcgcctgttttgtttccctttaccccgaatggaacttagaagtaatgcacactgatcaatagcaggcgtggcaccagccacgtgatgatcaagcactactgtttccccggaccgagtatcaatagactgcttgcgcggttgaaggagaaaacgttcgttatccggctaactacttcgagaaacccagtaacaccatgaaggttgcaggcgatttcgctcagcacatccccagtgtagatcaggtcgatgagtcaccgcgttcccacgggcgaccgtggcggtggctgcgttggcggcctgcctatggggtaacccataggacgctctaatacggacatggtgcgaagagtctattgagctagttagtgttctccggcccctgaatgcggctaatcctaactgtggagcacatgcccctaatccaaggggtagtgtgtcgtaacgggcaactccgcagcggaaccgactactttgggtgtccgtgtttccttttattcttacattggctgcttatggtgacaattgagagattgttgccatatagctattggattggccatccggtgtctaatagagcgataatctaccagtttgttggatttgtaccactcaacttttcaacactcaagacactcaactacatactagcactcaacacagtaaa

SEQ ID NO: 964 - DNA, 739 bp, Human enterovirus sp.
  81, strain USA/CA68-10389, complete genome.1
ttaaaacagcctgtgggttgtacccacccacagggcccattgggcgcttgcacactggtattccggtacctttgtgcgcctgttttatacatcctacccccgtaacttagaagcaagatcacccgatcaccaggaaatgtggcaaaccagtcacattctgatcaagcacttctgtttccccggactgagtatcaataggctgttcacacggctgaaggagaaaacgttcgttacccggccaactacttcgaaaaacctagtatcaccgtgaacgttgcagagtgtttcgctcagcactttccccgtgtagatcaggtcgatgagtcaccgcattccccacgggcgaccgtggcggtggctgcgttggcggcctgcctgcggggcaacccgtaggacgctctaatacagacacggtgtgaagagtctattgagctagttggtagtcctccggcccctgaatgcggctaatcctaactgcggagcgagcgcttgtaatccaacaggtagctcgtcgtaacgggtaactctgcagcggaaccgactactttgggtgaccgtgtttccttttatttcattactggctgcttatggtgacaatcacagagttgttaccatatagctattggattggccatccggtgtcaaatagagcaattgtgtttctttttgttgggtttgtaccacttgacttgaccagctacaacactctgtgctacattgttagattgaacacagcaaa

SEQ ID NO: 965 - DNA, 740 bp, Coxsackievirus
  A12, isolate D89 polyprotein gene, complete cds.1
ttaaaacagcctgtgggttgcacccactcacagggcccactgggcgtcagcactctggtacctcggtacctttgtgcgcctgttttatatcccccccccattgaaacttagaagcaatgcacttcgatcaatagcgggcgcggcgcaccagccacgtcatgatcaagcacttctgtttccccggaccgagtatcaatagactgctaacgcggttgagggagaaaacgtccgttacccggccaactgcttcgagaaatccagtaacatcatgaaaattgcagagtgtttcgctcagcacttccccagtgtagatcaggtcgatgagtcaccgcgttcctcacgggcgaccgtggcggtggctgcgttggcggcctgcctgtggggcaacccgcaggacgctctaatatggacatggtgtgaagaatctattgagccagttggtagtcctccggcccctgaatgcggctaatcctaactgcggagcacgcgccctcaatccagtgggtagcgtgtcgtaatgggtaactctgcagcggaaccgactactttgggtgtccgtgtttccttttattcttacattggctgcttatggtgacaattgagagattgttaccatatagctattggattggccatccggtatcgaatagagcggttatctatcaatttattggatttactccgttgagtgtgcagcagtatcgcactttgcttttaatagtgagactgaatagtgcaaa

SEQ ID NO: 966 - DNA, 740 bp, Enterovirus sp.
  A76, strain 17-1936-1_A76, complete genome.1
tgtgggttgttcccacccacagggcccactgggcgccagcactctgattccatggaatctttgtgcgcctgttttataacccttccccaatttgcaacttagaagtaatacacactacagatcaatagtaggcatggcgcgccagtcatgtctcgatcaagcacttctgtttccccggactgagtatcaatagactgcccacgcggttgaaggagaaaacgtccgttacccggctaactacttcgagaaacctagtagcaccaaataagctgcagagcgtttcgctcagcacctcccccgtgtagatcaggctgatgagtcactgcaatccccacgggcgaccgtggcagtggctgcgctggcggcctgcctatggggcaacccataggacgctctaatgtggacatggtgcgaagagtctattgagctagttagtagtcctccggcccctgaatgcggctaatcctaactgcggagcacataccttcaatccaggaggtggtgtgtcgtaacgggtaactctgcagcggaaccgactactttgggtgtccgtgtttccttttatccttatattggctgcttatggtgacaatcacggaattgttgccatatagctattggattggccatccggtgtctaatagagctattgtatacctatttgttggatttaccaagttaaatatcaccaactacaccacccttctttatattatattactgaatattagaaagagaaa

SEQ ID NO: 967 - DNA, 740 bp, Human echovirus
  18, strain Metcalf polyprotein gene, complete cds.1
ttaaaacagcctgtgggttgtacccacccacagggcccactgggcgctagcactctggtattacggtacctttgtgcgcctgttttacatcccttcccaatcgtaatttagaagccaaacactacgatcaatagtgggcgtggcacgccagccatgtctcgatcaagcactcctgtttccccgggccgagtatcaatagactgctcacgtggttgaaggagaaaacgctcgttatccggctaactacttcgagaaacctagtaacaccatggaagttgcagagtgtttcgttcagcacttccccagtgtagatcaggccgatgagtcaccgcgttccccacgggtgaccgtggcggtggctgcgttggcggcctgcccatggggtaacccatgggacgctctaatatggacatggtgtgaagagtctattgagctagttggtagtcctccggcccctgaatgcggctaatcctaactgcggagcatgtacctccaatccaggaggtggcgtgtcgtaatgggcaactctgcagcggaaccgactactttgggagtccgtgtttccttttattcttacactggctgcttatggtgacaattgagagattgttaccatatagctattggattggccatccggtgactaacagagcagttatctaccagttcgttggtttcattccattgtgtactcgcgaatacaacactcttcttttaatactagatttaaacaaagcaaa

SEQ ID NO: 968 - DNA, 741 bp, Simian sapelovirus 1
  strain 2383, complete genome.1
ctcacactcatttcccccctcgcctgtcacaggcaacccccaccccttctcttacgggagttagggccaaggatctgttgcataggcgttgtatcccctaaccttttacctacccatcccaataggactggtatttcggttttgattgagtaatggatactgattctatacctgttacccattcaggggaaaaatggagtttctttcatggatctgacttgatatgaccaagagtcaacactttgcgtgttggccgtatggaatgctttaaggtttattctttggattatgacttcagggttggccgcccaggataaaaggcaattgtggtaagtgatgttagtcattggtggttgaaacctgcctaagacgtcctaggtctacgctgtgcgggccgaagtaagcttaggaataacagggagtatgccattttctgctttcacccaacacgaccgtacacgaaagagctagaggcactttggggcaaagggaaaagctttgcttagcccgaatgttcatttgagtccttgacgaatgcgtcccgtctgtcccgacggtgaggcgtatggcgcatgctcatggcattacccaatggtgtatctgtgaggggggggctcctcacacttagtctagtgctacctgacagggccgcggctggtcgtttgtgtatggtataaccagtagtaatcccccatggattgctttaacttcccctcctcccttaccaagacattctctaag

SEQ ID NO: 969 - DNA, 741 bp, Coxsackievirus
  A10, strain 12-2067-2, complete genome.1
ccgatgtgtgggttgtacccacccacagggcccactgggcgctagcactctaatcctacgggattcttgtgcgcctgttttataaccccttccccgatttgtaacttagaagcaatttacattagcgatcaatagacgacatggcacgccagccatgtcttgatcaagcacttctgtttccccgggctgagtatcaatagactgcttacgcggttgaaggagaaaacgctcgttacccggctaactacttcgagaaacctagtagcatcatgaaaactgcagagcgtttcgttcagcactccccccgtgtagatcaggtcgatgagtcactgcaatccccacgggtgaccgtggcagtggctgcgttggcggcctgcctatggggcaacccataggacgctctaatgtggacatggtgcgaagagtctattgagctagttagtagtcctccggcccctgaatgcggctaatcctaactgcggagcgcatactcccaacccagggggtggtgcgtcgtaatgggcaactctgcagcggaaccgactactttgggtgtccgtgtttccttttatccttttattggctgcttatggtgacaattagagaattgttaccatatagctattggattggccatccggtgagcaacagagcaattgtgtatctttttgttggatacgtccccttgacacttagaacctacaacacgctacactatattctaatcttgaactcgagacg

SEQ ID NO: 970 - DNA, 741 bp, Unknown
  Description of Unknown: Human coxsackievirusA5, strain Swartz, complete genome.1 sequence
ttaaaacagcctgtgggttgcacccacccacagggcccactgggcgccagcactctggtatcgcggtacctttgtgcgcctgttttatgacccctccccaaccgaaacttagaagttacacataccgatcaatagtgggcatagcacgccagctgtgtcttgatcaagcacttctgtttccccggaccgagtatcaatagactgctcacgcggttgaaggagaaagcgttcgttatccggctaactacttcgagaaacctagtaacaccatgaaagttgcggagtgtttcgctcagcacttccccagtgtagatcaggtcgatgagtcaccgcgttccccacgggcgaccgtggcggtggctgcgctggcggcctgcctatgggatgacccataggacgcttcaacacagacatggtgtgaagagtctattgagctagttagtagtcctccggcccctgaatgcggctaatcctaactgcggagcacgtgccctcaagccagagggtggcgtgtcgtaacgggcaactctgcagcggaaccgactactttgggagtccgtgtttccttttattcttacactggctgcttatggtgacaattgagagattgttaccatatagctattggattggccatccggtgagcaacagagcgattgtatactcttttgtgggttttgtgccattaaatcttactgtgattaccacactgaaactcatcttgcagtttaatacagcaaa

SEQ ID NO: 971 - DNA, 741 bp, Coxsackievirus
  A10, isolate 2015-XMCDC-85-CA10, complete genome.1
gcattggaggctagcccccattggggcgtagcacttccactgggggctagcactccgattctgcggaatctttgtgcgcctgttttataaccctcccccaacttgcaacttagaagttatgtacgttgatcaatagcaggcgtggcacaccagccatgtcttgatcaagcacttctgtaaccccggactgagtatcaatagactgctcacgtggtcgaaagagaaaatgttcgttatccggctaactacttcgagaaacctagtagcaccactgaaactgcggagtgtttcgctcagcacttcccccgtgtagatcaggtcgatgagtcactgcttaccccacgggtgaccgtggcagtggctgcgttggcggcctgcctatggggcaacccataggacgctctaaagtggacatggtgtgaagagtctattgagctagttagtagtcctccggcccctgaatgcggctaatcctaactgcggagcgcatgcccccaaaccagagggtggtgcgtcgtaacgggtaactctgcagcggaaccgactactttgggtgtccgtgtttcttttattctcataatggctgcttatggtgacaattgaggaattgttaccatatagctattggattggccatccggtgtgcaacagagctattatctacttgtttgttggatacattccattgacacctaaatccttcaatacattgcactatattctaacgttgaacgcaagaaa

SEQ ID NO: 972 - DNA, 741 bp, Echovirus
  E9, strain UW1, complete genome.1
taaaacagcctgtgggttgttcccacccacagggcccactgggcgctagcacactggtatcacggtacccttgtgcgcctgttttatccacccgccccctatgtaacttagaagcacatcacaaacggtcaacaggcagctcagtaaaccaactgagccacgaccaggtacttctgttaccccggaccgagtatcaatagactgctgacgcggtcgaaggagaaaacgttcgttacccggccaactacttcgagaaacccagtaccaccatggaggttgcgtggcgtttcgctccacacaaccccagtgtagatcaggtcgatgagtcaccgcattccccacgggcgaccgtggcggtggctgcgttggcggcctgcccatgaggtaactcatgggacgctacaataccgacatggtgcgaagagtctattgagctagttggtagtcctccggcccctgaatgcggctaatcctaactgcagagcggacacctacaaaccagtgggcagtccgtcgtaacgggcaactctgcagcggaaccgactactttgggtgtccgtgtttccttttattctcatattggctgcttatggtgacaattgagagattgttgccatatagctattggattggccatccggtgactaacagagctattgtctacttatttgttggttacgcaccgctcaatttcaaagtcttaaacacgattaatttcatattatcactcaacacaacaaa

SEQ ID NO: 973 - DNA, 741 bp, Human echovirus
  31, strain Caldwell complete genome.1
ttaaaacagcctgtgggttgttcccacccacagggcccatgggcgctagcacactggtatcgtggtacctttgtgcgcctgttttatacaccctccccatttgtaacttagaagtaaagcaatattgatcaatagcaagcatggcacaccagccgtgttcagatcaagcacttctgtaaccccggactgagtatcaataggctgccaaagcggctgaaggagaaaacgttcgttaaccggccaactacttcgagaagcccagtatcaccatgaaagttgcagagcgtttcgctcagcactccccccgtgtagattaggtcgatgagtcaccgcatcccccacaggcgactgtggcggtggctgcgttggcggcctacctacggggcaacccgtaggacgctctaatacagacatggtgagaagagcctattgagctagttggtagtcctccggcccctgaatgcggataatcctaactgcggagcatgtgctcgcaatccagcgagaggcatgtcgtaacgggcaactctgcagcggaaccgactactttgggtgtccgtgtttccttttattccttgtttggctgcttatggtgacaattgaaagattgttgccatatagctattgggtcggccacctggtatctaacagagcaattatttacttgtttgttggttttgtacccttaaatctcaaggttcttgaaacccttaactacacattgaaactcaattcattgaa

SEQ ID NO: 974 - DNA, 741 bp, Echovirus
  E11, strain 520k/YN/CHN/2010 polyprotein gene, complete1
ttaaaacagcctgtgggttgttcccactcacagggcctactgggcgctagcactctggtatcacggtacctttgtgcgcctgttttacacacccccctccctaggaatttagaagcaatacacaatgatcaatagtaggcgtggtacgccaaccatgtcttgatcaagcacttctgttcccccggactgagtatcaatagactgctcacgcggttgaaggagaaaacgttcgttacccggccagctacttcgagaaacccagtaacaccatggaaatagcggggcgtttcgctcggcacatccccagtgtagatcaggtcgatgagtcaccgcattccccacgggtgaccgtggcggtggctgcgttggcggcctgcctacagggcgacctgtaggacgcttcaatatggacatggtgcgaagagtctattgagctagctggtagtcctccggcccctgaatgcggctaatcctaactgcggagcgcgcgcctccaatccagggggtggtgcgtcgtaatgggtaactctgcagcggaaccgactactttgggtgtccgtgtttccatttatccttatattggctgcttatggtgacaattgaaaggttgttaccatatagctattggattggccatccagtgtctaacagagcgattgtattcctcttcgttggatttgttccacttaacaaaacaaattaccaaactttgtgttatattgtcaaactaaacacagcaaa

SEQ ID NO: 975 - DNA, 741 bp, Human echovirus
  21, strain Farina complete genome.1
ttaaaacagcctgtgggttgttcccacccacagggcccaccgggcgctagcacactggtatcgcggtacctttgtgcgcctgttttatttaccctgccctgatgtaacttagaagcatgacaccaacgatcaatagcaggctcaatgcaccaattgggtcaagatcaagcacttctgttaccccggactgagtatcaataagctgctagcgcggctgaaggagaaaaagttcgttacccggccagctacttcgagaaacctagtatcaccatgaaagttgcgtggcgtttcgctccgcacaaccccagtgtagatcaggtcgatgagtcaccgcattccccacgggcgaccgtggcggtggctgcgttggcggcctgcccgtggagcaatccatgggacgctataatacagacatggtgtgaagagtctattgagctagctggtagtcctccggcccctgaatgcggctaatcctaactgcggagcaggtacccacgaaccagtgggcagtctgtcgtaatgggcaactccgcagcggaaccgactactttgggtgtccgtgtttccttttatttcaacttggctgcttatggtgacaattgagagattgttaccatatagctattggattggccatccggtgactaacagagctatcatatacctttttattggctttgtgccacttactctgaaagaggtcaagactctgcattatatcatactattgaatgctataaa

SEQ ID NO: 976 - DNA, 741 bp, Human echovirus
  26, strain Coronel complete genome.1
ttaaaacagcctgtgggttgttcccacccacagggcccactgggcgctagcacaccggtatcacggtacccttgtgcgcctgttttatccacctcccccgttgtaacttagaagctcaatacaaatggtcgatagccagcccgatacgccaattgggttttgaccaagcacttctgttaccccggactgagtaccaataggctgccaaagcggctgaaggggaaaacgttcgttaccccaccaactacttcgagaaacctagtaccaccatgaagattgcgcagcgtttcgctcagcacaaccccagtgtagatcaggtcgatgagtcaccgcattccccacaggcgactgtggcggtggctgcgttggcggcctgcccatggggctacccatgggacacttcaatatcgacatggtgcgaagagtctattgagctagttggtagtcctccggcccctgaatgcggataatcctaactgcggagcaggcacccacaagccagtgggcagcctgtcgtaacgggcaactctgcagcggaaccgactactttgggtgtccgtgtttctttttattcttacactggctgcttatggtgacaattgaagaattgttaccatatagctattggattggccatccagcgactaacagagctattatcttcttgtttgtggggtacgtaccactcaatttcacagtagtaaggactctcaatttcattttgtgcttgaataaggcgaa

SEQ ID NO: 977 - DNA, 741 bp, Echovirus
  E3, isolate 123-R2, complete genome.1
ttaaaacagcctgtgggttgtacccactcacagggcccactgggcgctagcacactggtatcacggtacctttgtgcgcctgttttataatcccttccccaccgtaacatagaagctacacacactgatcaacagcaggcacagcacaccagttgtgtctcgatcaagcacttctgtctccccggaccgagtatcaatagactgcttacgcggttgaaggagaaaacgttcgtcacccggctgactacttcgaaaagcctagtagtaccatgaatgttgcggagtgtttcgctcagcacttcccccgtgtagatcaggctgatgagtcactgcattccccacgggtgaccgtggcagtggctgcgttggcggcctgcccatggggcaacccatgggacgcttcaatacagacatggtgcgaagagtctattgagctagtcagtagtcctccggcccctgaatgcggctaatcctaactgcggagcatgcgcctccgacccagggggtagcatgtcgtaatgggcaactctgcagcggaaccgactactttgggtgtccgtgtttccttttattcttatattggctgcttatggtgacaattgagagattgttgccatatagctattggattggccatccggtgagtaatagagctattatatactcctttgtgggttttgtgccactggatcacaaggtcttgaaaactctcacttttgtcataatactaaacactgcaaa

SEQ ID NO: 978 - DNA, 741 bp, Coxsackievirus
  B1 gene for polyprotein, complete genome, strain1
taaaacagcctgtgggttgttcccacccacagggcccattgggcgctagcacactgatatcacggtacctttgtgcgcctgttttatctacccctccccgatgcaacttagaagcatgttacaaacggtcaataggtggttcagttaaccaactgagcctcgaccaagcacttctgttaccccggactgagtatcaataggctgctcgcgtggctgatggagaaaacgtccgttacccggccaattacttcgagaaacctagtaccaccatggaagttgcgcagcgtttcgctccgcacaaccccagtgtagatcaggtcgatgagtcactgcgttccccacgggtgaccgtggcagtggctgcgttggcggcctgcccatggggtatcccatgggacgcttcaatactgacatggtgtgaagagtctattgagctaattggtagtcctccggcccctgaatgcggctaatcctaactgcggagcagatacccacgcaccagtgggcagtctgtcgtaacgggcaactctgcagcggaaccgactactttgggtgaccgtgtttccttttattttaatattggctgcttatggtgacaattgaaagattgttgccatatagctattggattggccatccggtaacaaacagagcaattatttacctgtttattggttttatacctctcaaccacaaggttataagtactctcaaccttgttttagcatttaacacagcaaa

SEQ ID NO: 979 - DNA, 741 bp, Human enterovirus
  74, strain Rikaze-136/XZ/CHN/2010, complete1
ttaaaacagctctggggttgttcccacccacagggcccactgggcgctagcatactggtatcacggtacctttatgcgcctgttttatccacccctccccaacgtaacctagaagacactcatggatgatcaataggaggctcggcatgccagctgagtctggatcaagcacttctgttgccccggaccgagtatcaataggctgctcacgcggctgaaggagaaaaagttcgttatccggccaattacttcgagaaacccagtaccaccatgaaggttgcgtggcgtttcgctccgcacagccccagtgtagatcaggtcgatgagtcaccgcgttccccacgggcgaccgtggcggtggctgcgttggcggcctgcccatggggtaacccatgggacgcttcaatactgacatggtgcgaagagtctattgagctaattggtagtcctccggcccctgaatgcggctaatcctaactgcggagcagacgtccacaaaccagtgggtggtctgtcgtaacgggcaactctgcagcggaaccgactactttgggtgtccgtgtttcctttattcttatattggctgcttatggtgacaattgagagattgttgccatatagctattggattggccatccggtttgcaatagagcgattatactcctctttgttgggtttgtacctctcaacctcaatagttacaggacattattatacattatccagctgaacacgaaaag

SEQ ID NO: 980 - DNA, 741 bp, Enterovirus sp.
  B, strain LEV14, complete genome.1
taaaacagcctgtgggttgttcccacccacagggcccactgggcgctagcacactggtatcacggtacctttgtgcgcctgttttatttaccctcccccaacgtaacttagaagcatgactcaaatggtcaacagacaactcagcatgccagctgagcctcgaccaagcacttctgttaccccggactgagtaccagtaagctgctcacgcggctgagagggaaaccgttcgttacccggccaattacttcgagaaacctagtaccaccatgaaagttgcgcagtgtttcgctccgcacaaccccagtgtagatcaggtcgatgagtcaccgcaaaccccacgggtgaccgtggcggtggctgcgctggcggcctgcccatggggcagcccatgggacgcttcaatactgacatggtgcgaagagtctattgagctaattggtgatcctccggcccctgaatgcggctaatcctaactgcggagcagatacccacgcaccagtgggcagtctgtcgtaatgggcaactctgcagcggaaccgactactttgggtgtccgtgtttccttttattcttatactggctgcttatggtgacaattgagagattgttgccatatagctattggattggccatccggttacaaacagagcaattacttacctatttgttggttttgtaccactgaactacaaagtcttgaacaccctcaatttcattacaacacctaacacgttaaa

SEQ ID NO: 981 - DNA, 741 bp, Unknown
  Description of Unknown: Human coxsackievirus B4, strain BM24G/NM/CHN/2010, complete genome.1 sequence
ttaaaacagcctgtgggttgttcccacccacagggcccactgggcgctagcacactggtatcatggtacctttgtgtgcctgttttatttcccttccccagatgcaacttagaagcaacactccacgaccactagcaggcgtggcacaccagccatgtcttggtcaagcacttctgtaaccccggactgagtatcaataaactgctcacgcggtcgaaggagaaaacgtccgttacccggccaactacttcgagaaacctagtaacgccatgaaaattgcgaggtgtttcgctcagcacatccccagtgtagatcaggtcgatgagtcaccgcattccccacaggtaactgtggcggtggctgcgttggcggcctgcccatggggtgacccatgggacgcttcaatacggacatggtgtgaagagtctattgagctagttggtagtcctccggcccctgaatgcggctaatcctaactgtggagcatgcgcccccactccagagggtagcgtgtcgtaacgggtaactccgcagcggaaccgactactttgggtgtccgtgtttctttttattcttatattggctgcttatggtgacaattgaaagattgttaccatatagctattggattggccacccagtgacaaacagagcaataatttaccaatttgtgggatttattccaataagtttgaaagtcttgaagacacttaatctagtattacaactcaatagcgcaaa

SEQ ID NO: 982 - DNA, 741 bp, Enterovirus
  B, isolate NL/17-470/FAE/2017 polyprotein gene, complete1
ccagggggccctgtgggtgggtgcaacccacagggcccactgggcgctagcacactggtattacggtacctttgtgcgcctgttttatacacccttaccctatgcaatatagaagcaaaacgacaaggtcaatagagagcccagtgagccaactgggtcgagaccaagcacttctgtttccccggaccgagtatcaataggctgcttacgcggctgaaggagaaaacgttcgttacccggctaactacttcgaaaaacctagtaacgccatggaagttgcgaaccgtttcgctcggcacttccccagtgtagatcaggtcgatgagtcaccgcattccccacgggcgaccgtggcggtggctgcgttggcggcctgcctatggggcaacccataggacgcttcaatatggacatggcgtgaagagtctattgagctagttagtagtcctccggcccctgaatgcggctaatcctaactgcggagcacatgcccccaacccaggaggtggtgtgtcgtaatgggtaactctgcagcggaaccgactactttgggtgtccgtgtttccttttatcccaatgttggctgcttatggtgacaattgaaagattgttaccatatagctattggattggccatccggtgactaacagagcaatcgtttacctattcattggttacgttccattaaatctcaaggaactaacgactctcaattacattttgctcttgaactctgcaaa

SEQ ID NO: 983 - DNA, 741 bp, Unknown
  Description of Unknown: Human coxsackievirus B1, isolate CVB1Nm polyprotein gene, complete1 sequence
ttaaaacagcctgtgggttgttcccacccacagggcccattgggcgctagcactctggtatcacggtacctttgtgcgcctgttttacatcccctccccaaattgtaatttagaagtctcacacaccgatcaatagcaagcgtggcacaccagccatgttttgatcaagcacttctgttacccggactgagtatcaatagaccgctaacgcggttgaaggagaaaacgttcgttacccggccaactacttcgaaaaacctagtaacaccatggaagttgcggagtgtttcgctcagcactaccccagtgtagatcaggtcgatgagtcaccgcgttccccacgggcgaccgtggcggtggctgcgttggcggcctgcctacggggaaacccgtaggacgctctaatacagacatggtgcgaagagtctattgagctagttggtaatcctccggcccctgaatgcggctaatcctaactgcggagcacataccctcaaaccagggggcagtgtgtcgtaacgggcaactctgcagcggaaccgactactttgggtgtccgtgtttcattttattcctatactggctgcttatggtgacaattgacgggttgttaccatatagttattggattggccatccggtgactaacagagcaattatatatctctttgttgggtttataccacttagcttgaaagaggttaaaacactacatctcatcattaaactaaatacaacaaa

SEQ ID NO: 984 - DNA, 741 bp, Unknown
  Description of Unknown: Human coxsackievirus B1, strain MSH/KM9/2009, complete genome.1 sequence
ttaaaacagcctgtgggttgttcccacccacaggcccattgggcgctagcactctggtatcacggtacctttgtgcgcctgttttatacacccttcccaagtgtaacttagaagcttaccacacacggtcaataggcgactcagtaagccaactgggtcttgatcaagcacttctgtttccccggactgagtatcaataagctgctcacgcggctgaaggagaaaacgttcgttaaccggccaattacttcgagaaacctagtaacaccatggaggttgcgcagcgtttcgctccgcacaaccccagtgtagatcaggccgatgagtcaccgcactcctcacgggcgaccgtggcggtggctgcgctggcggcctgcccatggggtaacccatgggacgcttcaatactgacatggtgcgaagagtctattgagctaattggtagtcctccggcccctgaatgcggctaatcctaactgcggagcagatacccacatgccagtgggcagtctgtcgtaatgggcaactctgcagcggaaccgactactttgggtgtccgtgtttccttttattcttatactggctgcttatggtgacaattgagagattgttaccatatagctattggattggccatccagtgacaaacagagcgattatttatttgtttgttggttatatcccattaagccaaaaagtcttagccactctcaatttcatactattgcttaatacaacgaa

SEQ ID NO: 985 - DNA, 742 bp, Coxsackievirus
  A16, isolate CV-A16-A13-BLR-IN, complete genome.1
ttaaaacagcctgtgggttgttcccacccacagggcctactgggcgctagcacactggtatcccggtacctttgtgcgcctgttttatctacccctccccaagtgaaacttagaagatcatcacatatggtcaataggcggctcagtacaccaactgcgtctcgaccaagcacttctgtatccccggactgagtatcaatagactgctcacgcggttgaaggagaaaacgttcgttatccggctaactacttcgggaagcctagtagcaccttgaaagttgcggagtgtttcgctcagcacttcccccgtgtagatcaggccgatgagccactgtaaaccccacgggcgaccgtgacagtggctgcgctggcggcctgcccatgggggaacccatgggacgctctaatactgacatggtgtgaagagtctactgagctagttagtagtcctccggcccctgaatgcggctaatcctaactgcggagcacacaccctcaacccagggggcagtgtgtcgtaatgggtaactctgcagcggaaccgactactttgggtgaccgtgtttccttttattccttattggctgcttatggtgacaattgaaaagttgttaccatatagctattggattggccatccggtatctaatagagctattgtttacttatttattggatacgtccctcttaatttcaaggctatccaaactcttgattatatattgctccttaattataagaa

SEQ ID NO: 986 - DNA, 742 bp, Coxsackievirus
  A16, isolate Wh16, complete genome.1
ttaaaacagcctgtgggttgttcccactcacagggcccactgggcgctagtacactggtatctcggtacctttgtacgcctgttttataccccctccctgatttgcaacttagaagcaacgcaaaccagatcaatagtaggtgtgacataccagtcgcatcttgatcaagcacttctgtatccccggaccgagtatcaatagactgtgcacacggttgaaggagaaaacgtccgttacccggctaactacttcgagaaacctagtaacgccattgaagttgcagagtgtttcgctcagcactccccccgtgtagatcaggtcgatgagtcaccgcattccccacgggcgaccgtggcggtggctgcgttggcggcctgcccatggggtaacccatgggacgctctaatatagacatggtgcgaagagtctattgagctagttagcagacctccggcccctgaatgcggctaatcctaactgcggagcgcgcaccctcaacccagggggcggcgtgtcgtaatgggtaactctgcagcggaaccgactactttgggtgtccgtgtttccttttattctttattggctgcttatggtgacaattgaaaagttgttaccatatagctattggattggccatccggtgtctaacagagctattgtctacctatttattggatacgtccctcttaatctcaaggccattcaaactcttgattatatattgctcctcaactgtaggaa

SEQ ID NO: 987 - DNA, 742 bp, Unknown
  Description of Unknown: Human coxsackievirus A7, strain Parker, complete genome.1 sequence
tttaaaacagcctgtgggttgtccccacccacagggcccactgggcgttagcactctggtattacggtacctttgtgcgcctgttttataacccctccccaactgtaaattagaagcaacacacgtcgatcaatagtaggcgtgacgcaccagtcacgtcttgatcaagcacttctgtttccccggaccgagtatcaatagactgctcacgcggttgaaggagaaaacgttcgttacccgaccaactacttcgaaaaacctagtagcaccatgaaggttgcggagtgtttcgctcggcacttccccagtgtagatcaggtcgatgagtcaccgcattccccacgggcgaccgtggcggtggctgcgctggcggcctgcctatggggtaacccataggacgctctaatacggacatggtgcgaagagtctattgagctagttggtagtcctccggcccctgaatgcggctaatcctaactgcggagcgcgcgcccccattccaggaggtagcgcgtcgtaacgggcaactctgcagcggaaccgactactttgggtgtccgtgtttccttttatctttattctggctgcttatggtgacaattgacagattgttaccatatagctattggattggccatccggtcacaagcagagcgattatctaccaatttattggatttatcccactgcacactcgtgaatataacacattactgctgatactgagtttggacaaagcaaa

SEQ ID NO: 988 - DNA, 742 bp, Unknown
  Description of Unknown: Human coxsackievirus A2, strain Fleetwood, complete genome.1 sequence
ttaaaacagcctgtgggttgcacccacccacagggcccactgggcgctagcactctggtatcacgatacctttgtgcgcctgttttatatccccaccccgagtaaacgttagaagttacgcaaccccgatcaatagtaggtgtagcactccagctgcatcgagatcaagcacttctgtctccccggaccgagtatcaatagactgctaacgcggttgaaggagaaaacgttcgttacccggccaattacttcgagaagcccagtagtgccgtgaaagttgcggagtgtttcgctcagcacttcccccgtgtagatcaggctgatgagtcaccgcgatccccacaggtgactgtggcggtggctgcgttggcggcctgcctatggggcaacccataggacgctctaatacagacatggtgcgaagagcctattgagctaattggtagtcctccggcccctgaatgcggctaatcctaactgcggagcacatgccctcaaaccagggggtggtgtgtcgtaacgggtaactctgcagcggaaccgactactttgggtgtccgtgtttctttttattcttataatggctgcttatggtgacaattaaagaattgttaccatatagctattggattggccatccggtgactaacaaatcgctcatataccagtttgttggttttgttcccttatcacatacagctcataacaccctcttatatttactacaattgaatagcaagaa

SEQ ID NO: 989 - DNA, 742 bp, Unknown
  Description of Unknown: Human coxsackievirusA3, strain Olson, complete genome.1 sequence
ttaaaacagcctgtgggttgtacccacccacagggcccactgggcgctagcacactggtattacggtacctttgtgcgcctgttttataccccccccaacctcgaaacttagaagtaaagcaaacccgatcaatagcaggtgcggcgcaccagtcgcatcttgatcaagcacttctgtaaccccggaccgagtatcaatagactgctcacgcggttgaaggagaaaacgttcgttacccggctaactacttcgagaaacccagtagcatcatgaaagttgcagagtgtttcgctcagcactacccccgtgtagatcaggccgatgagtcaccgcacttccccacgggcgaccgtggcggtggctgcgttggcggcctgcctatggggcaacccataggacgctctaatacggacatggtgcgaagagtctattgagctagttagtagtcctccggcccctgaatgcggctaatcctaactgcggagcacatacccttaatccaaagggcagtgtgtcgtaacgggtaactctgcagcggaaccgactactttgggtgtccgtgtttccttttaatttttactggctgcttatggtgacaattgaggaattgttgccatatagctattggattggccatccggtgactaacagagctattgtgttccaatttgttggatttaccccgctcacactcacagtcgtaagaacccttcattacgtgttatttctcaactcaagaaa

SEQ ID NO: 990 - DNA, 742 bp, Human enterovirus sp.
  80, isolate HZ01/SD/CHN/2004, complete genome.1
ttaaaacagcctgtgggttgatcccacccacagggcccactgggcgctagcacactggtatcccggtacctttgtgcgcctgttttatttacccttccccaatgtaatttagaagtttatcccaaatggtcaatagacaacccagcacgccagctgggcttcgaccaagcacttctgttaccccggaccgagtatcaataggctgctcacgcggctgaaagagaaaatgttcgttacccggccaaccacttcgagaaacttagtatcaccatgaaagttgcgcagtgtttcgctccgcacagccccagtgtagatcaggtcgatgagtcaccgcgttccccacgggcgaccgtggcggtggctgcgttggcggcctgcccatggggcaacccatgggacgcttcaatactgacatggtgcgaagagtctattgagctggttggtagtcctccggcccctgaatgcggctaatcctaactgcggagcagatacctacacaccagtgggcagtctgtcgtaacgggcaactctgcggcggaaccgactactttgggtgtccgtgtttccttttattcttatattggctgcttatggtgacaattgaaagattgttaccatatagctattggattggccatccagtgacaaacagagctatcgtgtacctatttgttggttttgtaccactgaaccgtaaggtgttagacactctaaacctcataattctgttcaattcagcaaa

SEQ ID NO: 991 - DNA, 742 bp, Enterovirus sp.
  B80, isolate HT-LYKH203F/XJ/CHN/2011, complete genome.1
ttaaaacagctctggggttgttcccacccacagggcccaccgggcgccagcactctggtatcacggtacctttgtgcgcctgttttatacccccgtccccggttgtaacttagaagtaacactccacgaccgatagtaggtgtggcacgccagccatgtcttggtcaagcacttctgtttccccggattgagtatcaataggctgttcacacggccgaaggagaaaacatccgttatccggccaactacttcgagaaacctagtaccaccatgaaggttgcgcagtgtttcgctccgcacaaccccagtgtagatcaggccgatgagtcaccgctttccccacgggcgaccgtggcggtggctgcgttggcggcctgcccatggggaaatccatgggacgcttcaatactgacatggtgcgaagagtctattgagctagttggtattcctccggcccctgaatgcggctaatcctaactgcggagcagacacccacatgccagtgggcagtctgtcgtaacgggcaactctgcagcggaaccgactactttgggtgtccgtgtttccttttattcttatactggctgcttatggtgacaattgaaagattgttaccatatagctattggattggccatcctgtgactaacagagctattgtatacctatttgttggttttgtgccactgaattacaaggctttaaacaccctcaactttataatactactcaactcattaaa

SEQ ID NO: 992 - DNA, 742 bp, Enterovirus sp.
  B80, isolate KOUAN67/XZ/CHN/2010, complete genome.1
ttaaaacagctctggggttgttcccacccacagggcccactgggcgccagcactctggtattccggtaccctagtgcgcctgttttatcctcccctccccgttgaaacttagaagcaagtcacatgcggtcaatagggggcctagtatgccaactaggtcacgaccaagcactcctgttaccccggactgagtatcaataagctgctcgcgcggctgaaggagaaaacgttcgttacccggctaattacttcgagaaacccagtaccaccgtgaaggttgcgcagcgtttcgctccgcacaaccccagtgtagatcaggtcgatgagtcaccgcaatccccacaggcgactgtggcggtggctgcgttggcggcctgcccatgggacaacccatgggacgcttcaatactgacatggtgcgaagagtctattgagctaattagtaatcctccggcccctgaatgcggctaatcctaactgcggagcagatacccacacaccagtgggcagtctgtcgtaacgggcaactctgcagcggaaccgactactttgggtgtccgtgtttccttttattcttatactggctgcttatggtgacaattgacagattgttaccatatagctattggattggccatccggtgacgaacagagcgattatttacctgtttgttggttttataccacttaattacaaggttctaaacactctcaacttcattctaacactcaactcaacaaa

SEQ ID NO: 993 - DNA, 742 bp, Unknown
  Description of Unknown: Human coxsackievirus A24, strain BRA87-10629 polyprotein gene,1 sequence
ttaaaacagctctggggttgttcccaccccagaggcccacgtggcggctagtactccggtatcacggtacccttgtacgcctgttttatactccctgccccgtaacttagaagcaaaccaaacaagttcaataggagggggtgcaagcccgcaccaccacgaacaagtactcctgtctccccggtgaggttgtatagactgtacccacggttgaaaacgactgatccgttatccgctctagtacttcgggaagcctagtagcattttggaatcttcgatgcgttgcgctcagcactcaaccccggagtgtagcttaggtcgatgagtctggacatcccccaccggtgacggtggtccaggctgcgttggcggcctacctgtggtccaaagccacaggacgctagttgtgaacaaggtgtgaagagcctactgagctactagagagtcctccggcccctgaatgcggctaatcctaaccacggagcaggtagttgcaacccagcaaccagtctgtcgtaatgcgcaagtctgtggcggaaccgactactttgggtgaccgtgtttccttttattttcatatatggctgcttatggtgacaatcattgattgttatcatatagcgacttggattggccatccggtgagaattagaactactgtttacccgtttgctgatttttgataacactccacacacttaccatttgagaattgtactgttggcaagacagcaccattata

SEQ ID NO: 994 - DNA, 742 bp, Human echovirus
  9, strain Barty, complete genome.1
ttaaaacagcctgtgggttgttcccacccacagggcccattgggcgctagcacactggtatcacggtacccttgtgcgcctgttttatccacccctccccatcgtaacctagaagcatgactccaacggtcaatagacagctcagtaaaccaattgagccttgaccaagcacttctgttaccccggactgagtatcaataggctgctcacgcggccgaaggagaaaatgttcgttacccggccaattacttcgagaaacctagtaccaccatgaaggttgcgcggtgtttcgctcagcacaaccccagtgtagatcaggccgatgagtcaccgcattccccacgggtgaccgtggcggtggctgcgctggcggcctgcccatggggcaacccatgggacgcttcaatactgacatggtgtgaagagtctattgagctaattggtagtcctccggcccctgaatgcggctaatcctaactgcggagcagatacccacgcaccagtgggcagtctgtcgtaacgggcaactctgcagcggaaccgactactttgggtgtccgtgtttccttttattcttgtactggctgcttatggtgacaattgagagattgttaccatatagctattggattggccatccagtgtcaaacagagcgattgtctacttgttcattggttttataccattgagttacaaggttctagccactcttaacttcattttaacactcaatacatcaaa

SEQ ID NO: 995 - DNA, 742 bp, Human echovirus
  9, isolate DM, complete genome.1
ttaaaacagcctgtgggttgttcccacccacagggcccatggggcgcaagcacactggtattgcggtacctttgtgcgcctgttttatccacccttccccaatgaaacttagaagcttgactcaaacggtcaatagacagcccagtgcaccaactgggtctcgaccaggcactcctgtttccccggactgagtatcaataggctgcttgcgcggctgaaggagaaaacgttcgttacccggccaattacttcgagaaacctagtaccaccatggacgttgcgcagtgtttcgctccacacaaccccggtgtagatcaggtcgatgagtcaccgcaatccccacgggcgaccgtggcggtggctgcgctggcggcctgcccatggggcaacccatgggacgcttcaatactgacatggtgcgaagagtctattgagctaattggtagtcctccggcccctgaatgcggctaatcctaactgcggagcagatacccacataccagtgggcagtctgtcgtaacgggcaactctgcagcggaaccgactactttgggtgtccgtgtttccttttattcttatattggctgcttatggtgacaattgaaaggttgttaccatatagcttttggattggccatccagtgagcaacagagcgatcatactcctttttgttgggtttgtaccacttgattatagtagttacaacaccttgctatacgtcattcatttaaacacgagaaa

SEQ ID NO: 996 - DNA, 742 bp, Human enterovirus sp.
  101, strain CIV03-10361, complete genome.1
ttaaaacagcctgtgggttgttcccacccacagggcccactgggcgccagcactctggtattacggtacctttgtgcgcctgttttatatccccctccccacttgaaacttagaagtgaaacacactgatcaatagttgacatggcaagccagccatgtcttgatcaagcacctctgtttccccggacctagtatcaatagactgctcgcgcggttgaaagagaaagcgttcgttacccggctaactacttcgagaaacttagtaacaccatggaagttgcggagtgtttcgctcagcacatccccagtgtagatcaggccgatgagtcaccgcattccccacgggcgaccgtggcggtggctgcgttggcggcctgcctgtggggcaacccacaggacgctctaatacaaacatggtgcgaagagtctattgagctagttagtagtcctccggcccctgaatgcggctaatcctaactgcggagcacgtgcttccaatccaggaggtggcgtgtcgtaacgggtaactctgcagcggaaccgactactttgggtgtccgtgtttccttttattcttgcattggctgcttatggtgacaattgagagattgttaccatatagctattggattggccatccggtgacaaacagagcaattatatatctctttgttggatacattccattgaactacaaggagttaaaaaccctcaattatattctgttcttgaattccgcaag

SEQ ID NO: 997 - DNA, 742 bp, Human echovirus
  16, strain Harrington complete genome.1
ttaaaacagcctgtgggttgttcccacccacagggcccactgggcgcaagcacactggtattacggtacctttgtgcgcctgttttacatcccctctcccattataacttagaagcacatacaaaacgaccaataggtggtccagcactccagctgggctctggtcaagtacttctgttaccccggactaagtatcaataagcggctaacgcggctgaaggagaaagcgtccgttacccggccaactacttcgggaaatctagtaacaccatgaaggttgcgcagtgtttcgctccgcacaaacccagtgtagatcaggtcgatgagtcaccgcattccccacaggcgactgtggcggtggctgcgttggcggcctgcccatggggcaacccatgggacgcttcaatactgacatggtgcgaagaatctactgagctagttggtagtcctccggcccctgaatgcggctaatcctaactgcggagcacatacccctaacccaaggggcagtgtgtcgtaacgggcaactctgcagcggaaccgactactttgggtgtccgtgtttccttttattcttatactggctgcttatggtgacaattgagaaattgttaccatatagcttttggattggccatccagtgactaacagagctattatttacttgtttgttggctttgtaccactcaaccttagagttttaaggactctcaatttggttctgctatcgaatacaacaaa

SEQ ID NO: 998 - DNA, 742 bp, Enterovirus sp.
ttaaaacagcctgtgggttgttcccacccacagggcccactgggcgctagcacactggtatcacggtacctttgtgcgcctgttttatatccccctccccactgtaacttagagaaatcacataaacgatcaatagaaggcgcagcacaccagctgagtcttgaccaagcacttctgtttccccggactgagtatcaatagactgctcacgcggttgaaggagaaaacgttcgttacccggccaactacttcgagaaacctagtaccaccatgaaagttgcgcagtgtttcgctcagcacaaccccagtgtagatcaggtcgatgagtcaccgcattccccacgggcgaccgtggcggtggctgcgttggcggcctgcctatggggcaacccatgggacgcttcaatactgacatggtgcgaagagtctattgagctagttggtagtcctccggcccctgaatgcggctaatcctaactgcggagcaagtgcccacaaaccagtgggtagcttgtcgtaacgggcaactctgcagcggaaccgactactttgggtgtccgtgtttccttttattcttattctggctgcttatggtgacaattgagagattgttaccatatagctattggattggccatccggtgactaacagagcaatcatattcctctttgttggatttataccacttgattccactagttacaacactctgctacacattatttacttaaaaccaagaag

SEQ ID NO: 999 - DNA, 742 bp, Echovirus 5
  complete genome.1
ttaaaacagcctgtgggttgcacccacccacagggcccactgggcgctggtacactggtattaaggtacccttgtacgcctgttttatatccctcccccgatttgtaacttagaattaaagcaaacccgatcaatagtaggtgtggcaaaccagccacatcttgatcaagcacttctgtttccccggaccgagtatcaatagactgctgacgcggttgaaggagaaaacgttcgttacccggccaactacttcgggaaacctagtaccaccatgaaggttgcgcagtgtttcgctccgcacaaccccagtgtagatcaggtcgatgagccaccgcattccccacaggcgactgtggcggtggctgcgttggcggcctgcccatggggtaacccatgggacgcttcaatactgacatggtgcgaagagtccactgagctagttggtattcctccggcccctgaatgcggctaatcctaactgcggagcaggcacccacgagccagtgggcagcctgtcgtaatgggtaactctgcagcggaaccgactactttgggtgtccgtgtttccattttctttttattggctgcttatggtgacaatcacggaattgttaccatatagctattggattggccatccagtgactaacagagcagtaatattcctttttgttggttttgtaccactcaccgtcacgagcctcagaacactcgtattcatcttaacccttaacaagataaa

SEQ ID NO: 1000 - DNA, 742 bp, Human echovirus
  19, strain Burke complete genome.1
ttaaaacagcctgtgggttgtacccacccacagggcccaatgggcgctagcactccggtattacggtacccttgtgcgcctgttttatttccccttccccaactgaaacttagaagaaatacacaatgatcgacagtaagcgtggcgcaccagccatgttttgatcaagcacttctgtttccccggaccaagtatcaatagactgctcacgcggttgaaggagaaagcgttcgttaaccggctaactacttcgagaaacccagtaacaccatgaaagttgcagagtgtttcgctcagcactcccccagtgtggatcaggtcgatgagtcactgcgttccccacgggtgaccgtggcagtggctgcgttggcggcctgcctgtggggcaacccacaggacgctctaatacggacatggtgtgaagagtctattgagctagttagtagtcctccggcccctgaatgcggctaatcctaactgtggagcacatgcccctaacccaaggggtggtgtgtcgtaatgggtaactccgcagcggaaccgactactttgggtgaccgtgtttccttttatttttacattggctgcatatggtgacgattgagagattgttgccatatagctattggattggccatccagtgtctaacagagctattgtatatctttttgttggatttgtaccacttgacttgaaagaggtcaggacactacaatacattatactgctgaatactgcaaa

SEQ ID NO: 1001 - DNA, 742 bp, Human echovirus
  24, strain DeCamp complete genome.1
ttaaaacagcctgtgggttgcacccacccacagggcccacagggcgctagcactctggtatcacggtacctttgtgcgcctgttttattaccccttccccaattgaaaattagaagcaatgcacaccgatcaacagcaggcgtggcgcaccagtcacgtctcgatcaagcacttctgtttccccggaccgagtatcaatagactgctcacgcggttgaaggagaaagtgttcgttatccggctaaccacttcgagaaacccagtaacaccatgaaagttgcagggtgtttcgctcagcacttccccagtgtagatcaggtcgatgagtcaccgcgttccccacgggcgaccgtggcggtggctgcgttggcggcctgcctatgggttaacccataggacgctctaatacagacatggtgcgaagagtttattgagctggttagtatccctccggcccctgaatgcggctaatcctaactgcggagcacgtgcctccaatccagggggttgcatgtcgtaacgggtaactctgcagcggaaccgactactttgggtgtccgtgtttccttttattcttatactggctgcttatggtgacaatcgaggaattgttaccatatagctattggattggccatccggtgtctaacagagcgattatatacctctttgttggatttatgcagctcaataccaccaactttaacacattgaaatatatcttaaagttaaacacagcaaa

SEQ ID NO: 1002 - DNA, 742 bp, Coxsackievirus
  B3 clone CV-B3/28 2A C107S, complete genome.1
ttaaaacagcctgtgggttgatcccacccacagggcccattgggcgctagcactctggtatcacggtacctttgtgcgcctgttttataccccctcccccaactgtaacttagaagtaacacacaccgatcaacagtcagcgtggcacaccagccacgttttgatcaagcacttctgttaccccggactgagtatcaatagactgctcacgcggttgaaggagaaagcgttcgttatccggccaactacttcgaaaaacctagtaacaccgtggaagttgcagagtgtttcgctcagcactaccccagtgtagatcaggtcgatgagtcaccgcattccccacgggcgaccgtggcggtggctgcgttggcggcctgcccatggggaaacccatgggacgctctaatacagacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcctatactggctgcttatggtgacaattgagagattgttaccatatagctattggattggccatccggtgaccaatagagctattatatatctctttgttgggtttataccacttagcttgaaagaggttaaaacattacaattcattgttaagttgaatacagcaaa

SEQ ID NO: 1003 - DNA, 742 bp, Enterovirus sp.
  B111, strain Q0011/XZ/CHN/2000, complete genome.1
ttaaaacagcctgtgggttgttcccacccacagggcccactgggcgccagcacactggtatcacggtacccttgtgcgcctgttttataaacccttccccaatgcaacttagaagctcaactttaccggtcaatagacagtccagtacgccaactgggcttcgatcaagcacttctgttaccccggactaagtatcaataggctgctcacgcggctgaaggagaaaacgttcgttacccggccaattacttcgagaaacccagtaacactatggaggttgcgcagtgtttcgttccacacaaccccagtgtagatcaggtcgatgagtcaccgctttccccacgggcgaccgtggcggtggctgcgttggcggcctgcccatggggcaacccatgggacgcttcaatactgacatggtgtgaagagtctattgagctaattggtattcctccggcccctgaatgcggctaatcctaactgcggagcagatactcacgagccagtgggcagtctgtcgtaacgggtaactctgcagcggaaccgactactttgggtgtccgtgtttccttttattcatatattggctgcttatggtgacaattgagagattgttaccatatagctattggattggccatccggtgactaatagagcaattgtttacctatttgttggctttgtgccgttgaactacaaggttttaaaaactattaactacatcctagtacttaacacgttgaa

SEQ ID NO: 1004 - DNA, 742 bp, Human echovirus
  7, strain Wallace polyprotein gene, complete cds.1
ttaaaacagcctgtgggttgttcccacccacagggcccattgggcgtcagcaccctggtatcacggtacctttgtgcgcctgttttatatcccttcccccaattgtaacttagaagaaacacacaccgatcaacagcaagcgtggcacaccagccatgttttggtcaagcacttctgttaccccggactgagtatcaatagactgctcacgcggttgaaggagaaagcgtccgttatccggccagctacttcgagaaacctagtaacaccatggaagttgcggagtgtttcgctcagcactaccccagtgtagatcaggtcgatgagtcaccgctttccccacgggcgaccgtggcggtggctgcgttggcggcctgcctatgggggaacccataggacgctctaatacagacatggtgcgaagagtctattgagctagctggtattcctccggcccctgaatgcggctaatcctaactgtggagcacatgcccctaatccaaggggtagtgtgtcgtaatgagcaattccgcagcggaaccgactactttgggtgtccgtgtttcctcttattcttgtactggctgcttatggtgacaattgagagattgttaccatatagctattggattggccatccggtgactaatagagctattgtgtatctctttgttggatttgtaccacttaatttgaaagaaatcaggacactacgctacattttactattgaacaccgcaaa

SEQ ID NO: 1005 - DNA, 742 bp, Human echovirus
  3 gene for polyprotein, genomic RNA,strain1
ttaaaacagcctgtgggttgtacccacacacagggcccactgggcgctagcacactggtatcacggtacctttgtgcgcctgttttataaccccttccccaaacgtaacgtagaagccacacacactgatcaacagtgggcacagcgcaccagccgtgtctcgatcaagcacttctgttttcccggactgagtatcaatagactgctcacgcggttgaaggagaaaacgttcgttacccggctgactacttcgagaagcttagtaacgctatgaaagttgcgaagtgtttcgttcagcactccccccgtgtagatcaggtcgatgagtcaccgcattccccacgggtgaccgtggcggtggctgcgctggcggcctgcccatggggtgacccatgggacgcttcaatacagacatggtgcgaagagcctattgagctagtcagtagtcctccggcccctgaatgcggctaatcctaactgcggagcatgtgccctcaatccagagggtagcgtgtcgtaacgggcaactctgcagcggaaccgactactttgggtgtccgtgtttctttttattcttatattggctgcttatggtgacaattgagagattgttgccatatagctattggattggccatccggtgagtaacagagctattatttactccatcgtaggcttcgtgccattgaactacaaggtcttgaaaactctcaactttgttataatacttaataccacaaa

SEQ ID NO: 1006 - DNA, 742 bp, Enterovirus sp.
ttaaaacagcctgtgggttgttcccacccacagggcccactgggcgctagcacactggtatcacggtacccttgtgcgcctgttttatcttcccctccccactgtaacttagaagaatgacataaacggtcaacagatagctcagtacaccaactgagccccgaccaagcacttctgttaccccggaccgagtaacaataggctgctcgcgcggctgaaggtgaaaacgttcgttacccggccaattacttcgagaaacctagtaccaccatgaaggttgcgcagcgtttcgctccgcacaaccccagtgtagatcaggtcgatgagtcaccgcactccccacgggcgaccgtggcggtggctgcgctggcggcctgcctatggggcaacccatgggacgcttcaatactgacatggtgcgaagagtctattgagctaattggtagtcctccggcccctgaatgcggctaatcctaactgcggggcaagtgcccacaaaccagtgggtggcttgtcgtaacgggtaaccctgcagcggaaccgactactttgggtgtccgtgtttccttttattcttattctggctgcttatggtgacaattgagagattgttgccatatagctattggattggccatctggtgagtaacagagcaatcatattcctctttgttggatttataccacttgattccactagttacaacactctgctacatattatttgcttaaatacaagaag

SEQ ID NO: 1007 - DNA, 742 bp, Echovirus
  E19, strain NGR_2014, complete genome.1
ttttaaagcctgtgggttgttcccacccacagggcccattgggcgctagcactctggtattgcggtacctttgtgcgcctgttttatatccccctcccccatttgaaacttagaagcaagacacaccgatcaatagctgatatggcaagccagccatatcttgatcaagtacttctgtttccccggaccgagtatcaatagactgcttgcgcggtcgaaggagaaagcgttcgttacccggctaattacttcgagaaacctagtaacaccatgaaagttgcagagtgtttcgctcagcacaaccccagtgtagatcaggctgatgagtcaccgcattccccacgggtgaccgtggcggtggctgcgttggcggcctgcctgtggggcaacccacaggacgctctaatacagacatggtgtgaagagtctattgagctaattagtagtcctccggcccctgaatgcggctaatcctaactgcggagcacgtacccccattccaggaggtggcgtgtcgtaacgggtaactctgcagcggaaccgactactttgggtgtccgtgtttccttttatctttacactggctgcttatggtgacaattgaaagattgttaccatatagctattggattggccatccggtgacaaatagagcgattgtatatttgttcattggatttgtaccactaagctataaagcattaaacactcttaaccttatcctagtgcttaactcaacaaa

SEQ ID NO: 1008 - DNA, 742 bp, Echovirus
  E9, strain MSH/KM812/2010, complete genome.1
ttataaacagcgggctgggttgctcccactacagggcccacggcgcgcaagcacactggtatcacggtacttttgtgcgcctgttttatccaccctcccccaatgaaacttagaagcttgattcaaacggtcaatagacaacccagtacaccaactgggtctcgaccaagcacctctgtttccccggactgagtatcaataggctgcttacgtggctgaaggagaaaacgttcgttacccggccaattacttcgagaaacctagtaccaccatgaacgttgcgcagtgtttcgctccacacaaccccagtgtagatcaggtcgatgagtcaccgcattccccacgggtgaccgtggcggtggctgcgctggcggcctgcccatggggtaacccatgggacgctacaatactgacatggtgtgaagagtctattgagctaattggtagtcctccggcccctgaatgcggctaatcctaactgcggagcagatactcacatgccagtgggcagtctgtcgtaacgggcaactctgcagcggaaccgactactttgggtgtccgtgtttccttttattctcatctggctgcttatggtgacaatcgaaagactgttaccatatagctattggattggccatccagtgagtaacagagcgatcattttcctttttgttgggtttataccacttgattacaatagttacaataccttgctatacatcgttcatttgaacacaacaag

SEQ ID NO: 1009 - DNA, 742 bp, Enterovirus sp.
  B84, isolate AFP452/GD/CHN/2004, complete genome.1
ttaaaacagcctgtgggttgttcccacccacagggcccactgggcgctagcacactggtatcacggtacccttgtgcgcctgttttatcaaccccttcccgatgtaacttagaagccaaatcttaccggtcaacaggtggtccagtatgccaactgggctctgaccaagcacttctgttaccccggactgagtatcaataggctgctcacgcggctgaaggagaaaatgtccgttacccggccaattacttcgagaaacctagtaccaccatgaaggttgcgcggcgtttcgctccacacaaccccagtgcagatcaggtcgatgagccaccgcttcccccacgggcgaccgtggcggtggctgcgttggcggcctgcccatgggacaacccatgggacgcttcaatactgacatggtgcgaagagtctattgagctaattggtagtcctccggcccctgaatgcggctaatcctaactgtggagcagatgcccgcaagccagcgggtggtctgtcgtaacgggcaactccgcagcggaaccgactactttgggtgaccgtgtttccttttatttttatactggctgcttatggtgacaattgaaagattgttaccatatagctattggattggccatccggtgactaacagagctatcatatatctatttgttggttacgtcccacttgactatagagttctacgcaccttatatttcattttagatctgaacaaagcgag

SEQ ID NO: 1010 - DNA, 742 bp, Human enterovirus sp.
  106, isolate 148/YN/CHN/12, complete genome.1
ttaaaacagcctgtgggttgttcccacccacagggcccatggggcgccagcacactggtattgcggtacctttgtgcgcctgttttattcaccctttcccaatgaaacttagaagcttaactcaaccggtcgatagacagcccagtacaccaactgggttttgaccaagtactcctgtttccccggactgagtatcaataagctgctcgcgcggctgaaggagaaaacgttcgttacccggccaattacttcgagaaacctagtaccaccatgaacgttgcgcagtgtttcgctccgcacaaccccagtgtagatcaggtcgatgagtcaccgcaatccccacgggcgaccgtggcggtggctgcgctggcggcctgcccatggggcatcccatgggacgcttcaatactgacatggtgcgaagagtctattgagctaattggtaatcctccggcccctgaatgcggctaatcctaactgcggggcagacacccacacgccagtgggcagtctgtcgtaacgggtaactccgcagcggaaccgactactttgggtgtccgtgtttccttttatctttatattggctgcttatggtgacaattgaaagattgttgccatatagctattggattggccatccggtgtctaatagagcaattatatatctctttgttggcttcatcccgttaaataaagtgagctaccagaccctgtgctatattatcaaattgaacacaataaa

SEQ ID NO: 1011 - DNA, 742 bp, Human echovirus
  6, strain Charles, complete genome.1
ttaaaacagcctgtgggttgcccccacccgcagggcccattgggcgctagcacactggtatcacggtacctttgtgcgcctgttttatcctccctccccaagtgcaacgtagaagcaagacacaaaaggtcaacagatagcccagcacaccagttgggtttcgaccaagcacttctgtctccccggaccgagtatcaataagctgctcacgcggctgaaggagaaagcgttcgttacccggctagttacttcgagaaacccagtaccaccatgaaggttgcgcagcgtttcgctccgcacaaccccagtgtagatcaggtcgatgagtcaccgcgttccccacgggcgaccgtggcggtggctgcgttggcggcctgcccatggggcaacccatgggacgcttcaatactgacatggtgcgaagagtctattgagctaactagtagtcctccggcccctgaatgcggataatcttaactgcggagcaggtgctcacaatccagtgggtggcctgtcgtaacgggcaactctgcagcggaaccgactactttgggtgtccgtgtttccttttatctctttgttggctgcttatggtgacaattgaatgattgttgccatatagctattggattggccatccggtgagcagcagatccattatttaccagtttgttggatttgtaccacttgatcacatagtctttagaacacttgtctttattctaaatcttaacaaggcaag

SEQ ID NO: 1012 - DNA, 742 bp, Human enterovirus sp.
  85, strain BAN00-10353, complete genome.1
ttaaaacagcctgtgggttgttcccacccacagggcccaccgggcgctagcacactggtattgcggtacctttgtgcgcctgttttatacacccctccttaatgtaactcagaagtacaacattaccggtcaacagatgactcagtaaaccaactgagcctcgaccaagcacttctgtttccccggaccgagtatcaataggctgctcacgcggctgaaggagaaagtgttcgttacccggccaattacttcgagaagcccagtaccaccatggaggttgcgcggcgtttcgctccgcacatccccagtgtagatcaggctgatgagtcaccgcgttccccacgggtgaccgtggcggtggctgcgctggcggcctgcccatggggtaacccatgggacgcttcaatactgacatggtgtgaagagcctattgagctaattggtagtcctccggcccctgaatgcggctaatcctaactgcggagcagatacccacacaccagcgggcagtctgtcgtaacgggcaactctgcagcggaaccgactactttgggtgtccgtgtttccttttatttttatgctggctgcttatggtgacaattgaggaattgttaccatatagctattggattggccatccagtgtccaacagagcgatcatttacctgttcgttgggttcgtaccactaaaccacaagtcactcagcacacttaattacattataactctcaacacaacaag

SEQ ID NO: 1013 - DNA, 742 bp, Human enterovirus sp.
  97 genomic RNA, complete genome,strain:1
ttaaaacagcctgtgggttgttcccatccacagggcccactgggcgctagcacactggtatcacggtacctttgtgcgcctgttttatttcccccctcccgaagtaacctagaagcaggtaatatacggtcaataggtgacacagtataccaactgggtcttgaccaagcacttctgttaccccgggctgagtatcaataagctacttacgtggctgaaggagaaaacgctcgttacccggccaattacttcgagaaacctagtaacaccatgaaggttgcgcagtgtttcgctccgcacaaccccagtgtagaccaggtcgatgagtcaccgcattccccacgggcgaccgtggcggtggctgcgttggcggcctgcccatggggcaacccatgggacgcttcaaaactgacatggtgcgaagagtctattgagctaattggtagtcctccggcccctgaatgcggctaatcccaactgcggagcaaatacccacatgccagtgggcagtctgtcgtaatgggtaactctgcagcggaaccgactactttgggtgtccgtgtttctttttattcttatactggctgcttatggtgacaattgaggaattgttgccatatagctattggattggccatccggtgacaaacagagcaattatttacttgtttgttggattcgtaccgctaaaccacagagtactaagcacccttaattttattatattacttaactcgacaaa

SEQ ID NO: 1014 - DNA, 742 bp, Coxsackievirus
  B2, strain Ohio-1 polyprotein gene, complete cds.1
ttaaaacagcctgtgggttgttcccacccacagggcccactgggcgctagcacactggtattacggtacctttgtgcgcctgttttatctacccttgcccaatgcaacatagaagcttagtccaaaaggtcaataggcagcccagtgcaccaactgggtccagaccaagcacttctgttaccccggaccaagtatcagtaggctgctcacgcggctgaaggagaaaacgttcgttacccggccaactacttcgagaaacctagtagcaccatgaaggttgcgcagtgtttcgctccgcacagccccagtgtagatcaggtcgatgagccaccgcattccccacgggtgaccgtggcggtggctgcgttggcggcctgcccatggggtaacccatgggacgcttcaatactgacatggtgtgaagagtctattgagctagttggtagtcctccggcccctgaatgcggctaatcctaactgcggagcgtgcgcttgcaacccagtgagtagcacgtcgtaatgggtaactctgcagcggaaccgactactttgggtgtccgtgtttccttttattccttgtctggctgcttatggtgacaattgagagattgttgccatatagctattggattggccatccggtatctaacagggcgatcatttacctgtttgttggtttcatacccttgaatcttgaggtttataataccctcactcttataataaaactcaatacatcaag

SEQ ID NO: 1015 - DNA, 742 bp, Human echovirus
  13, strain Del Carmen complete genome.1
ttaaaacagcctgtgggttgtacccacccacagggcccactgggcgccagcacactggtatcacggtacccttgtgcgcctgttttatccacccctccccgaagtaacttagaagctctaaataagcggtcagcagccagcccagcacaccagctgggttttgaccaagtacttctgttaccccggaccgagtatcaataggctgcacacgcggctgaaggagaaaacgttcgttacccggccatctacttcgagaaacctagtaccactatgaaagttgcgaagcgtttcgctccacacaaccccagtgtagatcaggctgatgagtcaccgcattccccacaggtgactgtggcggtggctgcgttggcggcctgcccatggggcaacccatgggacgcttcaataccgacatggtgcgaagagtctattgagctagatggtagtcctccggcccctgaatgcggctaatcctaactgcggagcaggtgcacacaaaccagtgagtagcctgtcgtaatgggcaactctgcagcggaaccgactactttgggtgtccgtgtttctttttattcttatattggctgcttatggtgacaattgaaagattgttaccatatagctattggattggccatccggtgactagcagagcactgatatacctatttgtgggctttgtaccactcaactttgtcagctacaccacattgctatatattgtccaactgaacgcaagaag

SEQ ID NO: 1016 - DNA, 742 bp, Coxsackievirus
  B2 gene for polyprotein, complete cds,strain:1
ataaaacagcctgtgggttgttcccacccacagggcctactgggcgctagcacactggtattgcggtacctttgtgcgcctgttttatctgcccttccccaatgtaacttagaagttaaactcagacggccaatagacagcccagtacaccaactgggtctcggccaggcacttctgtttccccggactgagtatcaataagctgctcgcgcggctgaaggagaaaacgttcgttatccggccaattacttcgagaaacctagtaccaccatggacgttgcgcagtgtttcgctccgcacaaccccagtgtagatcaggtcgatgagtcaccgcaatccccatgggcgaccgtggcggtggctgcgctggcggcctgcccatgggtcaacccatgggacgcttcaatactgacatggtgtgaagagtctattgagctaattggtagtcctccggcccctgaatgcggctaatcccaactgcggagcagatacccacacgccagtgggcagtctgtcgtaacgggcaactctgcagcggaaccgactactttgggtgtccgtgtttccttttatccttacattggctgcttatggtgacaattgagagattgttaccatatagctattggattggccatccagtgagcaacagagcaattatatttctctttgttgggtttgtaccacttgattttgatagttacaacaccctactttatattgttcgcctgaacacgagaaa

SEQ ID NO: 1017 - DNA, 742 bp, Enterovirus sp.
  D111, strain ANG/2010-23294, complete genome.1
ttaaaacagctctggggttgttcccaccccagaggcccacgtggcggccagtactccggtattgcggtacccttgtacgcctgttttatactcccttcccccgtaacttagaagaaataaaccaagttcactaggagggggtacaaaccagtaccaccacgaacaagcacttctgtttccccggtgacattgcatagactgtacccacggttgaaagcgactgatccgttacccgctactgtacttcgagaagcctagtaccatcttggaatcttcgacgcgttgcgctcagcactcaaccccagagtgtagcttaggtcgatgagtctggacaatccccaccggtgacggtggtccaggctgcgttggcggcctacctgtggcccaaagccacaggacgctagttgtgaacaaggtgtgaagagcctattgagcttcagtagagtcctccggcccctgaatgcggctaatcccaaccacggagcaggtggtcataatccaatgactggcctgtcgtaacgcgcaagtctgtggcggaaccgactactttgggtgtccgtgtttccttttattttgtcaatggctgcttatggtgacaatctaagattgccatcatatagcttttggattggccatccggtattattttgagttatttgatttgttgtccacagctctttacagtatcacttaactattattgtttgtattttgctccttggatcacaaccaggtaatcaga

SEQ ID NO: 1018 - DNA, 742 bp, Human echovirus
  20, strain JV-1 complete genome.1
ttaaaacagcctgtgggttgttcccacccacagggcccattgggcgctagcactctggtattacggtacctttgtgcgcctgttttatgtcccctcccccaatcgcaacttagaagcaacacacactgatcaacagtaagcgtggcataccagccacgttttgatcaagcacttctgttaccccggactgagtatcaatagactgctcacgcggttgaaggagaaagcgttcgttatccggccaactacttcgagaaacctagtaacaccgtgaaagttgcagagtgtttcgctcagcactaccccagtgtagatcaggtcgatgagtcaccgcattccccacgggcgaccgtggcggtggctgcgctggcggcctgcctacggggaaacccgtaggacgctctaatacagacatggtgcgaagagtctattgagctagttggtagtcctccggcccctgaatgcggctaatcctaactgcggagcacacacccccaagccagggggcagtgtgtcgtaacgggtaactctgcagcggaaccgactactttgggtgtccgtgtttcattttattcctatgctggctgcttatggtgacaattgacagattgttaccatatagctattggattggccatccggtgactaatagagccattatataccactttgttgggtttataccactcaacttgaaagaggtcaaaacactacagctcatcattaaattgaacacaacaaa

SEQ ID NO: 1019 - DNA, 742 bp, Human enterovirus sp.
  83, strain USA/CA76-10392, complete genome.1
tttaaaacagcctgtgggttgttcccacccacagggcccactgggcgctagcactctggtatcacggtacccttgtgcgcctgttttatatccccaccccagtggaacattagaagcagcacacctatgatcaatagtgggcgtggcatccagtcacgttatgatcaagcacttctgtgaccccggactgagtatcaatagactgctcacgcggttgaaggagaaaacgttcgttacccggccagttacttcgagaaacccagtaacaccatgaatgttgcagagtgtttcgctcagcacttcccccgtgtagatcaggtcgatgagccactgcattccccacgggcgaccgtggcagtggctgcgttggcggcctgcctatggggtcacccataggacgctctaatactgacatggtgcgaagagtctattgagctaactggtagtcctccggcccctgaatgcggctaatcctaactgtggagcacattcccccaatccagggggcagtgtgtcgtaacgggcaactctgcagcggaaccgactactttgggtgtccgtgtttctttttattctcatattggctgcttatggtgacaattacagaattgttaccatatagctattggattggccatccggtgactaacagagcaattatttatcaattcgttggatttgtcccactcgatttcaaagcagtcaatacactctcatatatcgttacactcaacacaacaaa

SEQ ID NO: 1020 - DNA, 742 bp, Human enterovirus sp.
  97, strain 99188/SD/CHN/1999/EV97, complete1
ttaaaacagcctgtgggttgttcccacccacagggcccactgggcgctagcacactggtatcacggtacctttgtgcgcctgttttatccacccttccccaagtgacttagaagcataccacacacggtcaacaggcggctcaatgcaccaattgagtcatgaccaagtacttctgttaccccggacttagtatcaataagctgctcacgcggctgaaggagaaaacgttcgttacccggccaattacttcgagaaacctagtagcaccatggaggttgcgcggcgtttcgctccacacaaccccagtgtagatcaggctgatgagtcaccacaatcctcacgggcgaccgtggtggtggctgcgctggcggcctgcccatggggtaacccatgggacgctacaatactgacatggtgtgaagagtctattgagctaattggtagtcctccggcccctgaatgcggctaatcctaactgcggagcagatacccacacaccagtgggcagtctgtcgtaacgggcaactctgcagcggaaccgactactttgggtgtccgtgtttccttttttctcttatactggctgcttatggtgacaattgaaagattgttaccatatagctattggattggccatccagtgacaaacagagcgattgtttacctgttcattggtttcgtaccgctgaattacacagttttaaacacccttaatcttattttggcacttaatacatcaaa

SEQ ID NO: 1021 - DNA, 742 bp, Enterovirus sp.
  B, isolate EIS6B polyprotein gene, complete cds.1
ttaaaacagctctggggttgtacccactcacagggcccactgggcgctagcacactggtatcacggtacctttgtgcgcctgttttataaccccttccccaaacgtaacgtagaagctacacacactgatcaatagtaggcacagcgcaccagttgtgtcccgatcaagcacttctgtctccccggaccgagtatcaatagactgctcacgcggttgaaggagaaaacgttcgttaaccggctgactacttcgagaaacctagtagtactatgaaagttgcgaagcgtttcactcagcacttcccccgtgtagatcaggctgatgagtcactgcgttccccacgggtgaccgtggcagtgactgcgttggcggcctgcccatggggtaacccatgggacgcttcaatacggacatggtgcgaagagtctattgagctagccagtagtcctccggcccctgaatgcggctaatcctaactgcggagcatgtgccctcgatccagggggtagcgtgtcgtaacgggcaactctgcagcggaaccgactactttgggtgtccgtgtttctttttattcttatattggctgcttatggtgacaattgagagattgttaccatatagctattggattggccacccggtgactaatagagctattatctactcctttataggttttgtgccgttgaactacaaggtcttaaggactctcaactttatcataatacttaatactgcaaa

SEQ ID NO: 1022 - DNA, 742 bp, Echovirus
  25 mRNA for partial polyprotein,isolate M1262.1
ttaaaacagcctgtgggttgttcccatccacagggcccactgggcgcttgcactctggtatcacggtaccattgtgcgcctgttttatatcccctatccccagttgtaacttagaagcgatgccttccgaccaatagtgggcatggcacaccagtcatgtcttggtcaagtacacctgtttccccggactgagtatcaatagactgctcacgcggttgaaggagaaaacgttcgttacccggctaactacttcgagaaacctagtaacaccatgaatattgcgaagtgtttcgttcagcaccccccagtgtagatcaggccgatgagtcaccgcgttccccacaggcggccgtggcggtggctacgctggcggcctgcctatggggcaacccataggacgcttcaatgtggacatggtgtgaagagtctattgagctagttagtagtcctccggcccctgaatgcggctaatcctaatctcggagcaggcacccacaaaccagtgggcaacctgtcgtaatgggtaactctgcggcggaaccgactactttgggtgtccgtgtttccctttattcttgtattggctgcttatggtgacaattaggagattgttaccatatagctattggattggccatccggtgtctaacagagcaattatttacctctttgttggttacgtaccattaaactttaaggttatagcaacgctcaagtttatcctacttctcaataaagtaaa

SEQ ID NO: 1023 - DNA, 742 bp, Echovirus
  E6,isolate E6/RUS/Novosibirsk/NS09-D220/2009 polyprotein1
ttaaaacagcctgtgggttgttcccacccacagggcccactgggcgttagcacactggtatcaaggtacctttgtgcgcctgttttattcacccttccccttcgtaacttagaagcatagctcagacggtcaatagacagcccagcataccagctgggtcatgaccaagcacttctgttgccccggactgagtatcaataggctgcttgcgcggctgaaggagaaaagttcgttacccggccagttacttcgagaaacctagtaacaccatggaagttgcgtagtgtttcgctccgcacaaccccagtgtagatcaggtcgatgagtcaccgcataccccacgggtgaccgtggcggtggctgcgttggcggcctgcccatggggcatacccatgggacgctacaatactgacatggtgcgaagagtctattgagctaattggtagtcctccggcccctgaatgcggctaatcctaactgcggagcagatacccacacaccagtgggcggtctgtcgtaacgggtaactctgcagcggaaccgactactttgggtgtccgtgtttccttttattcctaatctggctgcttatggtgacaattgagagattgttaccatatagctattggattggccatccggtgactaacagagcgatcatctacctgtttgttggtttcattccactaaactacaaagtactaaacactctgaattacattttactgcttaactcatcaaa

SEQ ID NO: 1024 - DNA, 743 bp, Human enterovirus sp.
  71 polyprotein gene, complete cds.1
ttaaaacagctgtgggttgtcacccacccacagggtccactgggcgctagtacactggtatctcggtacctttgtacgcctgttttataccccctccctgatttgcaacttagaagcaacgcaaaccagatcaatagtaggtgtgacataccagtcgcatcttgatcaagcacttctgtatccccggaccgagtatcaatagactgtgcacacggttgaaggagaaaacgtccgttacccggctaactacttcgagaagcctagtaacgccattgaagttgcagagtgtttcgctcagcactccccccgtgtagatcaggtcgatgagtcaccgcattccccacgggcgaccgtggcggtggctgcgttggcggcctgcctatggggtaacccataggacgctctaatacggacatggcgtgaagagtctattgagctagttagtagtcctccggcccctgaatgcggctaatcctaactgcggagcacatacccttaatccaaagggcagtgtgtcgtaacgggcaactctgcagcggaaccgactactttgggtgtccgtgtttctttttattcttgtattggctgcttatggtgacaattaaagaattgttaccatatagctattggattggccatccagtgtcaaacagagctattgtatatctctttgttggattcacacctctcactcttgaaacgttacacaccctcaattacattatactgctgaacacgaagcg

SEQ ID NO: 1025 - DNA, 743 bp, Enterovirus sp.
  A71, isolate VR1432, complete genome.1
ttaaaacagcctgtgggttgcacccactcacagggcccactgggcgcaagcactctggcacttcggtacctttgtgcgcctgttttatatcccctcccccaatgaaatttagaagcagcaaaccccgatcaatagcaggcataacgctccagttatgtcttgatcaagcacttctgtttccccggactgagtatcaatagactgctcacgcggttgaaggagaaaacgttcgttatccggctaactacttcggaaagcctagtaacaccatggaagttgcggagagtttcgttcagcacttccccagtgtagatcaggtcgatgagtcaccgcattccccacgggcgaccgtggcggtggctgcgttggcggcctgcccatggggtaacccatgggacgctctaatacggacatggtgtgaagagtctactgagctagttagtagtcctccggcccctgaatgcggctaatcccaactgcggagcacacgcccacaagccagtgggtagtgtgtcgtaacgggcaactctgcagcggaaccgactactttgggtgtccgtgtttccttttattcttatgttggctgcttatggtgacaattaaagagttgttaccatatagctattggattggccatccggtgtgcaacagagcgatcgtttacctatttattggttttgtaccattgacactgaagtctgtgatcacccttaattttatcttaaccctcaacacagccaaac

SEQ ID NO: 1026 - DNA, 743 bp, Coxsackievirus
  A16 gene for polyprotein,isolate1
ttaaaacagcctgtgggttgtacccaccctcagggcccactgggcgccagcactctggtaccacggtacctttgtgcgcctgttttatcatcccacccctacctgaaacgtagaagcaataatcagtcgaccaatagtgggtgtggcacaccagccacatcttggtcaagcacttctgtttccccgggttgagtatcaatatgctgttcacacggctgaaggagaaaacgcccgttatccggccaactacttcgagaagcctagtatcgccatgaacattgcaaggcgtttcgctcagcacttcccccgtgtagatcaggccgatgagtcaccgcattccccacgggcgaccgtggcggtggctgcgttggcggcctgcctgtgggttgacccacaggacgccttaatatagacatggtgtgaagagcctattgagctggttggtattcctccggcccctgaatgcggctaatcctaactgtggagcacatactcacaagccagtgggtggtgtgtcgtaatgggcaactctgcagcggaaccgactactttgggtgtccgtgtttccttttatacttatactggctgcttatggtgacaatcagagaattgttaccatatagctattggattggccatccggtgtgcaacagagctattgtgtatttatttgttggatttgtcccactatcacatacatcccttaacactttgtattttattttgaaattaaacgcaagaaa

SEQ ID NO: 1027 - DNA, 743 bp, Coxsackievirus
  A10 gene for polyprotein, polyprotein region,strain1
tttaaaacagcctgtgggttgcacccacccacagggcccactgggcgctagcactctggtactgcggtacctttgtgcgcctgttttatcaccccaccccatctggaacgtagaagcaatgcacaactgaccaatagtgggtgtggcgcaccagccacatcttggtcgagcacttctgtttccccgggtttagtatcaataagctgctcacgcggctgaaggagaaaacacccgttatccggccgactacttcgagaaacctagtaccgctatgaacgttgcaaggcgtttcgttcagcacttcccccgtgtagatcaggccgatgagtcaccgcattcctcacgggcgaccgtggcggtggctgcgttggcggcctgcctatgggcttgcccataggacgccttaatactgacatggtgcgaagagtctattgagctagttggtagtcctccggcccctgaatgcggctaatcctaactgcggagcacatactcacaaaccagtgagcggtgtgtcgtaacgggcaactctgcagcggaaccgactactttgggtgtccgtgtttccttttattcttatactggctgcttatggtgacaattaaagaattgttaccatatagctattggattggccatccggtgtctaacagagctattatatacttgtttgttggattcatctcgttatcacacaaatcccttaacactttgtgttttatcttgaatttgaactcaaaaag

SEQ ID NO: 1028 - DNA, 743 bp, Unknown
  Description of Unknown: Human coxsackievirus A7,isolate 275/58, complete genome.1 sequence
tttaaaacagcctgtgggttgtacccacccacagggcctactgggcgccagcactctggtactatggtacctttgtgcgcctgttttatattcctcccccaaattgcaacttagaagacatgcactccgatcaatagcaggcgtggcgcaccagctgcgtcttgatcaagcatttctgtttccccggactgagtatcaatagactgctcacgcggttgagggagaaaacgtccgttacccggccaactacttcgagaagcctagtaacactatgaaagttgcggggcgtttcgctcagcactcccccagtgtagatcaggtcgatgagtcaccgcattccccacgggcgaccgtggcggtggctgcgttggcggcctgcctatggggcaacccatgggacgctctaatatggacatggtgtgaagagcttattgagctagttggtagtcctccggcccctgaatgcggctaatcctaactgcggagcacgtgcctccaaaccagaaggtggcgtgtcgtaatgggcaactctgcagcggaaccgactactttgggtgtccgtgtttccttttattcttactctggctgcttatggtgacaattgacagattgttaccatatagctattggattggccatccggtgacgaacagagcgattgtgtaccagtttattggtttcgtccacttgaatacacgtgaattcaataccttgctgttggtattgaatttcaatacaacaaa

SEQ ID NO: 1029 - DNA, 743 bp, Unknown
  Description of Unknown: Human coxsackievirus A8,strain Donovan, complete genome.1 sequence
ttaaaacagcctgtgggttgcacccacccacagggcccaatgggcgtcagcactctggtaccgaggtacctttgtgcgcctgttttatttccccttcccctgatgcaacttagaagctccgaactaatgatcaatagtaggtgtggcacgccagccacatcttgatcaagcacttctgtttacccggaccgagtatcaataagctgcgcaagcggctgaaggagaaagcgttcgttatccggccaactacttcgagaagcttagtaccaccatgaacgttgcagagtgtttcgttcagcacaaccccggtgtagatcaggccgatgagtcaccgcgttccccatgggcgaccatggcggtggctgcgttggcggcctgcccatggagcaatccatgggacgctctaatactgacatggtgcgaagagcctattgagctagttggtgatcctccggcccctgaatgcggctaatcctaactgcggagcatgcgcccacaagccagtgggtggtgtgtcgtaacgggtaactctgcagcggaaccgactactttgggtgtccgtgtttccttttatctttacattggctgcttatggtgacaattgaagaattgttaccatatagctattggattggccatccggtgtgcaatagagcgattatatacctatttgttggatttgttccattgacatatagatctcttaacactctacaacacatcttgatcttgaacacgagaaa

SEQ ID NO: 1030 - DNA, 743 bp, Coxsackievirus
  A8,isolate CVA8/SZ124/CHN/2012, complete genome.1
ttaaaacagcctgtgggttgtacccacccacagggcccactgggcgctagcactctgattctacggaatctttgtgcgcctgttttacaaccccctccccctatgtaacttagaagcaatgcaccaatgatcaacagcaggcgtggcgcaccagccatgtcttgatcaagcacttctgtttccccggacagagtatcaatagactgctcgcgtggtcgaaggagaaaacgtccgttacccggctaactacttcgagaaacctagtagcaccaatgaagctgcagagcgtttcgctcagcacttaccccgtgtagatcaggccgatgagtcactgcgttccccacgggcgaccgtggcagtggctgcgttggcggcctgcctatggggtcacccataggacgctctaatgtggacatggtgcgaagagtctattgagctagttagtagtcctccggcccctgaatgcggctaatcctaactgcggagcgcataccctcaaaccagggggtggtgcgtcgtaacgggtaactctgcagcggaaccgactactttgggtgtccgtgtttccttttattttcttaatggctgcttatggtgacaattgaggaattgttaccatatagctattggattggccatcaggtgtgtaacagagcaattatctacttgtttgtaggatataccccattaacgttcaaatctcttaacacactacagtacatactaactttgaacacaagaaa

SEQ ID NO: 1031 - DNA, 743 bp, Coxsackievirus
  A8,isolate CVA8/SZ266/CHN/2014, complete genome.1
ttaaaacagcctgtgggttgtacccacccacagggcccactgggcgccagcactctggtaatacgttacctttgtgcgcctgttttacctccccctaccctggaacactttagaagtaaagcatatctggtcaatagaaggtgtggcgaaccagctgcatctcgaccaagcacttctgtttccccggactgagtatcaatagactgctaacgcggtcgaaggagaaaacgttcgttatccggctagctacttcgagaagcctagtaacaccatgaaagttgcagagtgtttcactcagcacttcccccgtgtagatcaggtcgatgagtcaccgcgacccccacgggcgaccgtggcggtggctgcgttggcggcctgcctgtggggcaacccataggacgctctaatacagacatggtgtgaagagcctattgagctagctagtagtcctccggcccctgaatgcggctaatcctaactgcggagcacatgctcgtgaaccagcgagtagtgtgtcgtaatgggtaactctgcagcggaaccgactactttgggtgtccgtgtttctttttattcttacattggctgcttatggtgacaattaaagaattggcaccatatagctattggattggccatcctgtgactaacagagctattatatatctctttgttggatttgttcccttgaggctcactacttataacacactttgttttatattgactctcaattcagcaaa

SEQ ID NO: 1032 - DNA, 743 bp, Unknown
  Description of Unknown: Human coxsackievirus A2,strain CVA2/SD/CHN/09, complete genome.1 sequence
ttaaaacagcctgtgggttgtacccacccacagggcccactgggcgcgagcactctggtatcacgatacctttgtgcgcctgttttatatcccttccccattaatgtaacatagaagttatgcaccccgatcaatagcaggcatggcgctccagctatgtcttgatcaagcacttctgtttccccggactgagtatcaatagactgcttgcgcggttgaaggagaaaacgttcgttatccggctaactacttcgggaagcttagtaatgccatggaagttgcggagagtttcgctcagcacttccccagtgtagatcaggctgatgagtcaccgcattccccacgggtgaccgtggcggtggctgcgttggcggcctgcccatagggagacctatgggacgctctaatacggacatggtgtgaagagcctactgagctagttagcagtcctccggcccctgaatgcggctaatcctaactgcggagcacgcgtctccaatccaggggatagcgtgtcgtaatgggcaactctgcagcggaaccgactactttgggtgtccgtgtttccttttattcttacactggctgcttatggtgacaattgaggaattgttaccatatagctattggattggccatccggtgactaacagagctattatttaccaatttgttggatttgtacctctttcactcaccgtttaccacacccttctatacctattacaactgaatagtagaag

SEQ ID NO: 1033 - DNA, 743 bp, Unknown
  Description of Unknown: Human coxsackievirusA17,strain BAN01-10577, complete genome.1 sequence
ttaaaacagcctgtgggttgttcccaccccagaggcccacgtggcggctagtactctggtattacggtacctttgtacgcctgttttatactccctccccatgtaactttagaagcaattcaataagttcaatagagggggtacaaaccagtaccaccacgaacaagcacttctgtctccccggtgatcttgcatagactgttcccacggttgaaagcgagtgatccgttatccgcttgagtacttcgagaagcctagtaccaccttggaatcttcgatgcgttgcgctcagcactctgccccgagtgtagcttaggctgatgagtctgggctttccccaccggcgacggtggcccaggctgcgttggcggcctacccgtggtcaacaccacgggacgctagttgtgaacaaggtgtgaagagcctattgagctactcaagagtcctccggcccctgaatgcggctaatcctaaccatggagcaggtactctcaacccagagggcagcctgtcgtaacgcgtgagtccgtggcggaaccgactactttgggtgaccgtgtttccttttatttttgactggctgcttatggtgacaatcatagattgttatcatagagcgaattggattggccatccagtgaaatataaacacgttatctacttgtttgttggatttactccactcactcagtttacccctagcataataatagcagtactactgataaggaattattgccacc

SEQ ID NO: 1034 - DNA, 743 bp, Unknown
  Description of Unknown: Human coxsackievirus A9 genomic RNA, complete genome,strain:1 sequence
tttaaaacagcctgtgggttgttcccacccacaggcgccaccgggcgttagcacactggtatcacggtacccttgtgcgcctgttttataaccccaccccgagtaaaccttagaagcaatgcacctctggtcaatagtaggtgtgacacaccagtcacatcgtgaccaagcacttctgtctccccggactgagtatcaataggctgctcgcgcggctgaaggagaaagcgttcgttacccggccagctacttcgagaagcctagtaacaccatgaaggttgcagagtgtttcgctcagcacttcccctgtgtagatcaggccgatgagtcaccgcgttcctcacgggcgaccgtggcggtcgctgcgctggtggcctgcctatggggcaacccataggacgctctaatgctgacatggtgcgaagagtctattgagctagctggtagtcctccggcccctgaatgcggctaatcccaactgcggagcacgcaccctcaaaccagggggcagcgtgtcgtaacgggcaactctgcagcggaaccgactactttgggtgtccgtgtttctttttattcctatattggctgcttatggtgacaattgagagattgttaccatatagctattggattggccatccggtgagcaacagagctattgtgtatctgtttactggtttcataccccttaattacaaagaagtcaaaacccttcacttgatcttgttattcaatacaacaaa

SEQ ID NO: 1035 - DNA, 743 bp, Human poliovirus 1
  complete genome.isolated from faeces of1
ttaaaacagctctggggttgttcccaccccagaggcccacgtggcggccagtactctggtatcacggtacctttgtacgcctgttttatactcccttcccgcaacttagacgcataaaaaccaagttcaatagaagggggtacaagccagtaccaccacgaacaagcacttctgtttccccggtgatgttgtatagactgctcgcgtggttgaaagcgacagatccgttatccgcttgtgtacttcgagaagcccagtaccaccttggaatcttcgatgcgttgcgctcagcactcaaccccagagtgtagcttaggctgatgagtctggacatcccccaccggtgacggtggtccaggctgcgttggcggcctacccatggctaacgccatgggacgctagttgtgaacagggtgtgaagagcctattgagctacataagagtcctccggcccctgaatgcggctaatcccaacctcggagcaggtggtcacataccagtgactggcctgtcgtaacgcgcaagtccgtggcggaaccgactactttgggtgtccgtgtttccttttattttataatggctgcttatggtgacaatcacagattgtcgtcataaagcgaattggattggccatccggtgatagtgaaattcattacttaactgtttactggattcgctccaccgcaagtgtttgctctgagtacaatttcaatagttactttaagtagacaattgtattaca

SEQ ID NO: 1036 - DNA, 743 bp, Human echovirus
  15,strain CH 96-51 complete genome.1
ttaaaacagcctgtgggttgtacccacccacagggcccactgggcgctagcactctggtattacggtacccttgtgcgcctgttttatataccccgccccaagcaaacgctagatgtaacgcacttatgatcaatagcaggcgtggcactccagccacgttatgatcaagcacttctgtctccccggaccgagtatcaatagactgctcacgcggtcgaaggagaaaacgttcgttacccgaccagctacttcgagaaacctagtaactccatggaggttgcagagtgtttcgttcagcacttcccccgtgtagatcaggctgatgagtcaccgcgttcctcacgggcgaccgtggcggtggctgcgttggcggcctgcctatgggtatacccataggacgctctaatactgacatggtgcgaagagtctattgagctagttggtagtcctccggcccctgaatgcggctaatcctaactgcggagcacatacccccaacccagggggcagtgtgtcgtaacgggtaactctgcagcggaaccgactactttgggtgtccgtgtttccttttattcttacattggctgcttatggtgacaattgagagattgttaccatatagctattggattggccatccagtgactaacagagctattatttacctttttgttggcttcgtatcacttggtttaaaagaggttagtactttatattgcattatattactaaacacgagaaa

SEQ ID NO: 1037 - DNA, 743 bp, Echovirus
  E11,strain SD2003-478/SD/CHN/2003, complete genome.1
ttaaaacagcctgtgggttgttcccacccacagggcccactgggcgttagcactctggtatcgcggtacccttgtgcgcctgttttatccgccctttcccaaacgtaacttagaagctcaacttgaatggtcagcaggaaacccagtacgccaactgggtcacgaccaagcacttctgtaaccccgggccgagtatcaataagctgctcacgcggttgaaggagaaaacgcccgttacccggccaattacttcgagaaacctagtaccaccatggaggttgcgtagtgtttcgctccgcacaaccccagtgtagatcaggccgatgagtcaccgcgttccccacgggcgaccgtggcggtggctgcgttggcggcctgcccatgggataacccatgggacgcttcaatactgacatggtgcgaagagtctattgagctaattggtagtcctccggcccctgaatgcggctaatcccaactgcggagcagatacccacatgccagtgggcagtctgtcgtaacgggcaactctgcagcggaaccgactactttgggtgtccgtgtttccttttattcatacattggctgcttatggtgacaattgaaagattgttaccatatagctattggattggccatccggtgtctaatagagcgattgtctacttgttcattgggtttgtacctttaaaccttaaagttcttaacactctcaaccttgtgctacaactcaacacggcaaa

SEQ ID NO: 1038 - DNA, 743 bp, Human enterovirus sp.
  80,strain USA/CA67-10387, complete genome.1
ttaaaacagcctgtgggttgatcccacccacagggcccactgggcgtcagcactctggtatcacggtacctttgtgcgcctgttttatactccctccccccaaccgtaacttagaagcagcactaactgatcaatagccagcgcggcatgccagccacgcttcgatcaagcacttctgttaccccggactgagtatcaatagactgctcacgcggttgaaggagaaaacgttcgtcatccggccaactacttcgagaaacctagtaacaccatggaagttgcggagtgtttcgctcagcactaccccagtgtagatcaggtcgatgagtcaccgcattccccacaggcgactgtggcggtggctgcgttggcggcctgcccatggggaaacccatgggacgctcttatatagacatggtgcgaagagtctattgagctagttggtagtcctccggcccctgaatgcggctaatcctaactgcggagcatacaccctcaaaccagagggcagtgtgtcgtaatgggcaactctgcagcggaaccgactactttgggtgtccgtgtttcactttatttctaaattggctgcttatggtgacaattgagagattgttaccatatagctattggattggccatccggtgaccaatagagctattatatatctctttgttgggttcataccacttagcttgaaagaggttaaaactctgcattacattatactattgaattccgcaaa

SEQ ID NO: 1039 - DNA, 743 bp, Unknown
  Description of Unknown: Human coxsackievirus B5, strain ChZJ-1, complete genome.1 sequence
ttaaaacagcctgtgggttgttcccacccacagggcccattgggcgtcagcactctggtatcacggtacccttgtgcgcctgttttataatccctttccccacaagtaacttagacacagcacaaaccgatcaacagtaggcgtgacactccagtcatgtcgtgatcaagcacttctgttaccccggaccgagtatcaatagactgcttacgcggttgaaggagaaaacgcccgttacccggccaactacttcgagaaacccagtaacaccatggaaattgcggagtgtttcgctcagcacaaccccagtgtagatcaggtcgatgagccaccacattccccacgggtgaccgtggtggtggctgcgttggcggcctgcctatgggggaacccataggacgcttcaatacggacatggtgcgaagagtctattgagctagttggtaatcctccggcccctgaatgcggctaatcctaactgcggagcgcgtgcccccaaaccaggaggtggcgcgtcgtaatgggcaactccgcagcggaaccgactactttgggtgtccgtgtttccttttatatttttattggctgcttatggtgacaattgagaaattgttaccatatagctattggattggccatccggtgtctaacagagcgattatttatctttttgttggatttgtaccactcaacataacaaactatcagactttgtgttgcattattggattgaacacagcaaa

SEQ ID NO: 1040 - DNA, 743 bp, Enterovirus sp.
  B88, strain 11-4644-1, complete genome.1
tgtgctcttccgatctggttgttcccacccacagggcccactgggcgccagcacactggtattacggtacccttgtgcgcctgttttatccacccccccccactgtaacttagaagataaccacacgcggtcaataggtgactcagtacgccaactgggtcgcgaccaagcacttctgttaccccggaccgagtatcaataagctgctcgcgcggctgaaggagaaaacgttcgttacccggccaattacttcgagaaacctagtaccaccatggaggttgcgcagcgtttcgctccgcacaaccccagtgtagatcaggtcgatgagtcaccgcaatccccacaggcgactgtggcggtggctgcgttggcggcctgcccatggggaaacccatgggacgcttcaatatcgacatggtgcgaagagtctattgagctaattggtagtcctccggcccctgaatgcggctaatcctaactgtggagcagatacccacactccagtgggcagtctgtcgtaatgggcaactctgcagcggaaccgactactttgggtgtccgtgtttccttttattcctatgctggctgcttatggtgacaattgacagattgttaccatatagctactggattggccatccggtgacaagcagagcgattgtttacttatttgttggtttcattccactcaattataaagtactaaacacccttaatttcattataactcttaacacgttaaa

SEQ ID NO: 1041 - DNA, 743 bp, Echovirus
  E30, strain KM/A363/09 polyprotein gene, complete cds.1
ttaaaacagcctgtgggttgaacccatccacagggcccactgggcgcaagcacactggtatcacggtacctttgtgcgcctgttttatccacccttccccgaacgaaacttagaagtttgacttaaacggtcaatagaaagcccagtacaccaactgggtcgtgaccaagcacttctgtgaccccggactgagtatcaataagctactcacgtggctgaaggagaaaacgttcgttatccggccaattacttcgagaaacttagtaccaccatgaaggttgcgtagcgtttcgctccgcacaaccccagtgtagatcaggtcgatgagtcaccgcgttcctcacgggcgaccgtggcggtggctgcgttggcggcctgcccttggggcaacccaagggacgcttcaatactgacatggtgcgaagagtctattgagctaattggtagtcctccggcccctgaatgcggctaatcctaactgcggagcagatacccacatgccagtgggcagtctgtcgtaatgggcaactctgcagcggaaccgactactttgggtgtccgtgtttccttttattcttatactggctgcttatggtgacaattgagaaattgttaccatatagctattggattggccatccagtgtccaatagagcaatcatttaccttttcgttggatttattccacttgactacaaagcactcaaaacactcgaatacattgtagacctcaatacaacaaa

SEQ ID NO: 1042 - DNA, 743 bp, Echovirus
  E12, strain K624/YN/CHN/2013, complete genome.1
ttaaaacaaggctgtgggttgtacccacccacagggcccaccgggcgctagcacactggtatctaggtacccttgtgcgcctgttttattcgccccaccccatcgtaacttagaagttgatcaataatggtcgttaggtagcccagcacgccagctgggtcttgaccaagcacttctgttaccccggaccgagtatcaatacgctgctcacgcggctgaaggagaaaacgttcgttacccggccaattacttcgagaagcctagtaccaccatgaaggttgcgcagcgtttcgctccgcacaaccccagtgtagatcaggccgatgagtcaccgcactcctcacgggcgaccgtggcggtgactgcgttggcggcctgcccatggggtgacccatgggacgcttcaatactgacatggtgcgaagagcctattgagctaattggtagtcctccggcccctgaatgcggctaatcctaactgcggagcagatacccacacaccagtgggcagtctgtcgtaacgggcaactctgcagcggaaccgactactttgggtgtccgtgtttccttttattctaatattggctgcttatggtgacaattgaaaaattgttaccatatagctattggattggccatccggtgacaaatagagcgattgtttacctgtttgttggtttcataccattaaatcttaaagtcttaaaaacccttgattttatactagcactcaattcagcaaa

SEQ ID NO: 1043 - DNA, 743 bp, Human enterovirus sp.
  87, strain BAN01-10396, complete genome.1
ttaaaacagcctgtgggttgttcccacccacagggcccactgggcgctagcacactggtatcacggtacccttgtgcgcctgttttatacacccttcccctactgtgacttagaagcaaaacaatgatgaccaatagcaagcgcagcactccagctgtgtttcggtcaagcacttctgtttccccggactgagtatcaataggccactcacgtggccgaaggagaaaacgtccgttacccggccaattacttcgagaaacccagtaacaccatagaggttgcgcagcgtttcgctccgcactcccccagtgtagatcaggtcgatgagtcaccgcgttccccacgggcgaccgtggcggtggctgcgttggcggcctgcccatggggtaacccatgggacgcttcaatactgacatggtgcgaagagtctattgagctaattggtagtcctccggcccctgaatgcggctaatcctaactgcggagcagatacccacgctccagtgggcagtctgtcgtaacgggtaactctgcagcggaaccgactactttgggtgtccgtgtttccttttattcttatattggctgcttatggtgacaattgaaagattgttaccatatagctattggattggccatccggtgtctaatagagcaattatattcctgtttgttggttttataccactgaatatcacagtttacaagaccctcaattacatcctacgtttaaacaagacaaa

SEQ ID NO: 1044 - DNA, 743 bp, Echovirus
  E6, strain FIN09-NPA, complete genome.1
ttaaaacaggcctgtgggttggttccacccacagggcccactgggcgccagcacactggtattacggtacctttgtgcgcctgttttatccacccttccctgatgtaacttagaagtaaaacataggcggtcaataggtagcccaacacaccagttgggtttcgaccaaacacttctgttaccccggaccgagtatcaataggctgctcacgcggctgaaggagaaaacgttcgttacccgaccaattacttcgagaaacccagtaacaccatgaaagttgcgcagtgtttcgctccgcacaaccccagtgtagatcaggtcgatgagtcaccgcattccccacgggcgaccgtggcggtggctgcgttggcggcctgcccatgggctaacccatgggacgctacaataccgacatggtgcgaagagtctattgagctaattggtagtcctccggcccctgaatgcggctaatcctaactgcggagcagatacccacacaccagtgggcggtctgtcgtaacgggcaactctgcagcggaaccgactactttgggtgtccgtgtttccttttattcctatattggctgcttatggtgacaattgagagattgttaccatatagctattggattggccatccggtgacaaacagggcggtcatttacctatttgttggttttgtaccattgaattttaaggtattgaaaaccctcaaccttgttttagcactcaatacagcaaa

SEQ ID NO: 1045 - DNA, 743 bp, Human echovirus
  17, strain CHHE-29 complete genome.1
ttaaaacagcctgtgggttgttcccacccacagggcccattgggcgctagcactctggtattgcggtacctttgtgcgcctgttttatattccctccccctgaccgtaacttagaagtaacacacaccgatcaacagtaagcatggcacaccagccatgttttgatcaagcacttctgttatcccggactgagtatcaatagactgctcacgcggttgaaggagaaaacgttcgttacccggccaactacttcgaaaaacctagtaacaccatggaagttgcagagtgtttcgctcagcactaccccagtgtagatcaggtcgatgagtcaccgcattccccacgggcgaccgtggcggtggctgcgttggcggcctgcctatggggaaacccataggacgctctaatacagacatggtgcgaagagtctattgagctagttggtagtcctccggcccctgaatgcggctaatcctaactgcggagcacacaccctcaagccagggggcagtgtgtcgtaacgggcaactctgcagcggaaccgactactttgggtgtccgtgtttccccttactcttgtattggctgcttatggtgacaattttggaattgttgccatatagctattggattggccatccggtgacaaacagagcgattgtatacctattcgttggacttgtaccgctcaacgttacgagtctaacgactttatactacatcatctggttgaacacagcaaa

SEQ ID NO: 1046 - DNA, 743 bp, Echovirus
  E18, isolate E18-HeB15-54462/HeB/CHN/2015, complete1
ttataacagcctgtgggttgtacccacccacagggcccacagggggccagcacactggtatctcggtacctttgtgggcctgttttatccacccttcccccattttatttagaagcatgcaccaaaacggtcaacagggagcccagtaagccacttgttcattgaccaagtacttctgttaccccggaccgagtatcaataggctgctcgcgcggctgaaggagaaaacgttcgttacccggccaattacttcgagaaacccagtagcgccatggaggttgcgcagcgtttcgctccgcacaaccccagtgtagatcaggtcgatgagccaccgcgttccccacgggcgaccgtggcggtggctgcgttggcggcctgcccatgggactacccatgggacgcttcaatactgacatggtgtgaaaagtctattgagctaattggtagtcctccggcccctgaatgcggctaatcctaactgcggagcagacgcccacacaccagtgggcgatctgtcgtaatgggcaactctgcagcggaaccgactactttgggtgtccgtgtttccttttattcttaccctggctgcttatggtgacaattgagaagttgttgccatatagctattggattggccatccggtgacgagcagggcgataatttatttgtttatcgggtttgtaccactgaactacaaggttttaaacactttggattttattctgatcctcaactcactaaa

SEQ ID NO: 1047 - DNA, 743 bp, Echovirus
  E7, strain Ibadan_NGR_2010, complete genome.1
ccagtgggccctgtgggttgtacccacccacagggcccactgggcgctagcactctggtatcacggtaccttagtgcgcctgttttatatcccccacccccacttgaaacttagaagcaaaacatactgaccaatagttgacatggcaagccagccgtgccttggtcaagcacctctgtttccccggaccgagtatcaatagactgctagcgcggttgaaggagaaagcgttcgttacccgactaactacttcgaaaaacctagtagcatcatgaaagttgcagagtgtttcgctcagcacaaccccagtgtagatcaggccgatgagtcaccgcattcctcacgggtgaccgtggcggtggctgcgctggcggcctgcctgtggggcaacccacaggacgctctaatacagacatggtgcgaagagtctattgagctagttagtagtcctccggcccctgaatgcggctaatcctaactgcggagcacgtgcctctaatccaagaggtagcgtgtcgtaacgggcaactctgcagcggaaccgactactttgggtgtccgtgtttccttttatttttatactggctgcttatggtgacaattgagagattgttaccatatagctattggattggccatccggtgactaatagagctattgtatacctctttattggttacgttccattaaaccgcaaggaattaaggaccctcaattacatcttgcttttgaattcagcaaa

SEQ ID NO: 1048 - DNA, 743 bp, Swine vesicular disease virus
  strain SVDV Itl. 5-99 polyprotein1
ttaaaacagcttgtgggttgttcccacccacagggcccactgggcgccagtacactggtatcacggtacctttgtgcgcctgtttgactcaccttccccaaacgcaacttagaagcataacttaaatggtcattaggcggctcagtatgccaactgagtctcgatcaagcacttctgttaccccggactgagtaccaataggctgctcacgcggctgaaagggaaaccgttcgttacccgaccaactacttcgagaaacctagtaccaccatgaaagttgcgcggcgtttcgctccgcacaaccccagtgtagatcaggccgatgagtcaccgcaaaccccacgggcgaccgtggcggtggctgcgctggcggcctgcccatgggacaacccatgggacgccacaatactgacatgatgcgaagagtctattgagctagttggtagtcctccggcccctgaatgcggctaatcccaactgtggagcagatacccacgcaccagtgggcagtctgtcgtaatgggcaactctacagcggaaccgactactttgggtgtccgtgtttctttttattcctacgctggctacttatggtgacaattgagagactgtaaccatattgctatcgggttggccacctggtgaagaataaaacagttgctcactcgtttgtcagtcttgcaccgtcgtgccacaaagtcttaactgcccctcaacatcgtcataatactaaatacgctgaa

SEQ ID NO: 1049 - DNA, 743 bp, Coxsackievirus
  B5 complete genome.1
ttaaaacagcctgtgggttgtacccacccacagggcccactgggcgctagcactctggtaccgcggtacctttgtgcgcctgttttatatcccccctccccttaaccggaacttagaagttacacacactgatcaacagtgggcatagcatgccagctatgtcttgatcaagcacttctgtctccccggaccaagtatcaatagactgctcacgcggttgaaggagaaagcgttcgttacccgactaactacttcgagaaacccagtagcactatgaaagttgcgaggcgtttcgctcaacacttccccagtgtagatcaggtcgatgagtcaccgcattccccacggcgaccgtggcggtggctgcgttggcggcctgctacggggcaactcgtaggacgcttcaatacagacatggtgcgaagagtctattgagctagttagtagtcctccggcccctgaatgcggctaatcctaactgcggagcacataccctcaacccagggggcagtgtgtcgtaacgggtaactctgcagcggaaccgactactttgggtgtccgtgtttccttttatccttacattggctgcttatggtgacaattgaaagattgttaccatatagctattggattggccatccagtgtctaatagagctattatatacctctttgttggatttataccacttagcctaaaagaagttaagacactacagcttattgtacaattaaacacagcaaa

SEQ ID NO: 1050 - DNA, 743 bp, Coxsackievirus
  B5, isolate 3936/09, complete genome.1
ttaaaacagcctgtgggttgtacccacccacagggcccactgggcgctagcactctggtatcacggtacctttgtgcgcctgttttatgcccccttcccccaattgaaacttagaagttacacacaccgatcaacagcgggcgtggcataccagccgcgtcttgatcaagcactcctgtttccccggaccgagtatcaatagactgctcacgcggttgaaggagaaaacgttcgttacccggctaactacttcgagaaacctagtagcatcatgaaagttgcgaagcgtttcgctcagcacatccccagtgtagatcaggtcgatgagtcaccgcattccccacgggcgaccgtggcggtggctgcgttggcggcctgcctacggggcaacccgtaggacgcttcaatacagacatggtgcgaagagtcgattgagctagttagtagtcctccggcccctgaatccggctaatcctaactgcggagcacataccctcaacccagggggcattgtgtcgtaacgggtaactctgcagcggaaccgactactttgggtgtccgtgtttccttttattcttataatggctgcttatggtgacaattgaaagattgttaccatatagctattggattggccatccggtgtctaacagagctattatatacctctttgttggatttgtaccacttgatctaaaggaagtcaagacactacaattcatcatacaattgaacacagcaaa

SEQ ID NO: 1051 - DNA, 743 bp, Swine vesicular disease virus
  gene for polyprotein, complete cds.1
ttaaaacagcctgtgggttgttcccacccacagggcccactgggcgctagcacactggtatcacggtacctttgtgcgcctgtttgacttaccctccccaaacgcaacttagaagcacaacttaaatggtcaatagacggctcagtatgccaactgagtctcgatcaagcacttctgttaccccggactgagtaccaataggctgctcacgcggctgaaggggaaaccgttcgttacccgactaactacttcgagaaacctagtaccaccatgaaagttgcgcagcgtttcgctccgcacaaccccagtgtagatcaggccgatgagtcaccgcaaaccccacgggcgaccgtggcggtggctgcgctggcggcctgcccatggggcaactcatgggatgcttcaatactgacatggtgcgaagagtctattgagctagttggtagtcctccggcccctgaatgcggctaatcctaactgcggagcagatacccacgcaccagtgggcagtctgtcgtaatgggcaactctgcagcggaaccgactactttgggtgtccgtgtttccttttatccttatactggctacttatggtgacaattgagagattgtaaccatattgctattggattggccacccggcgacgaatagaacagttgcttacctgtttgttagtctcgtgtcactgaactgcaaggccttaaacaccctttaatttcatcataacgctcaatacgttaaa

SEQ ID NO: 1052 - DNA, 743 bp, Unknown
  Description of Unknown: Human coxsackievirus B3, strain GA, complete genome.1 sequence
ttaaaacagcctgtgggttgatcccacccgcagggcccactgggcgtaagcacactggtattacggtacctttgtgcgcctgttttatacacccctcccccgatgtaacttagaagttcaatgcaagcggtcgatagccagcccaacacaccagttgggttcagatcaagcacttctgttaccccggactgagtatcaataagctgctcacgtggctgaaagagaaaacgttcgttacccggccagttacttcgggaagcctagtaccaccatgaaagttgcgcagtgtttcgttccgcacaaccccagtgtagatcaggtcgatgagtcaccgcattccccacaggcgactgtggcggtggctgcgttggcggcctgcccatggggttacccatgggacgctacaatactgacatggtgcgaagagcctactgagctaactggtattcctccggcccctgaatgcggctaatcctaactgcggagcaagtacctgcagaccagcaggcagcttgtcgtaacgggcaactctgcagcggaaccgactactttgggtgtccgtgtttccttttattcttgttatggctgcttatggtgacaatcacagaattgttaccatatagctattggattggccatccagtgactaacagagcaattatatacttgtttgtcggatttgtcaaattagattttaacaacctacgcacgctttgttatattattgaattaaatacagcaag

SEQ ID NO: 1053 - DNA, 743 bp, Coxsackievirus
  B5, isolate CV-B5/P727/2013/China, complete genome.1
tttaaaacagcctgtgggttgttcccacccacagggcccaatgggcgctagcacactggtatcatggtacctttgtgcgcctgttttattcaccccatcacaataaaatggagaagcataacgtaataggtcaataggtggctcagtgcgccacttgggtttagaacaaacaattctgttttcccgcaccgagtatcaataaggtgctagcgtggatgaaggagaaaacgttagttacccgagtaattagttcgagaaagacagtaccaccatgaaggatgcgcagtgtttcgttcagcactaccccagtgtagatcaggtcgatgagtcaccgcgatccccacgggtgtccgtggcggtcctgtgttggcggcaaaaccatggggtaacccatagaacgataaaattaagacatggtgagaagagtttattgagctagttggtaatcatccggcccgggaatgcggctaatcttacatgcgcagcgggcacccacaaaccagtggaaacgtttgtcgtaacgggcaactctgcagcggaaccgactactgtggggggccgggttgccttgtattcatatattggctgcttatggggacgattgaaagattgttgccatatagctattggattggccatccggaaacaaacagagctattatttacctttttgttggctttgtgccgttgaatttcaaagttgtaaaaactataaacttcattttgacactcaatacagcaaa

SEQ ID NO: 1054 - DNA, 743 bp, Coxsackievirus
  B6, strain Schmitt, complete genome.1
ttaaaacagcctgtgggttgtacccacccacagggcccactgggcgctagcactctggtattgcggtacctttgtgcgcctgttttacccaccctcccccaacgtaacttagaagcctgacatatacggtcacaagccagcccagtacgccaactgggtaccgaccaagcacttctgttaccccggactgagtatcaataagctgccaaagcggctgaaggagaaaacgttcgttacccggccaattacttcgagaaacccagtaacaccatgaaagttgcgtagcgtttcattcagcacaatcccagtgtagatcaggtcgatgagtcaccgcattccccacaggcgactgtggcggtggctgcgttggcggcctgcccatggggcaaacccatgggacgcttcaatactgacatggtgcgaagagtctattgagctaattggtagtcctccggcccctgaatgcggctaatcctaactgcggagcaggcactcgcagaccagcgagcagcttgtcgtaatgggcaactccgcagcggaaccgactactttgggtgtccgtgtttcctatttcctttacactggctgcttatggtgacaattgagaaattgttaccatatagctattggagtggccatccggtgactaacagagcaataatatatttgtttgttggctttgtgccacttaatttgaaggttgttaagacgctcaatctgatactacttctaaataaagcaaa

SEQ ID NO: 1055 - DNA, 743 bp, Echovirus
  1 (strain Farouk / ATCC VR-1038) polyprotein precursor,1
ttaaaacagcctgtgggttgttcccacccacagggcccactgggcgttagcacactggtatcacggtacctttgtgcgcctgttttatactcccccccctaaggaaactttagaagcaaagcaattgtgatcaatagtgggtatggcacaccagtcatatcttgatcaagcacttctgttcccccggacttagtaccaatagactgctcaagcggttgaaggggaaaacgttcgttatccggccaactacttcgagaaacctagtagcaccatgaaagttgcggagtgtttcgctcagcacttcccccgtgtagatcaggctgatgagtcaccgtattccccacgggcgaccgtgacggtggctgcgttggcggcctgcccatggggtaacccatgggacgctctaaaacagacacggtgcgaagagtctattgagctagttggtagtcctccggcccctgaatgcggccaatcctaactgcggagcacatactcccaatccagggagcagtgtgtcgtaatgggtaactctgcagcggaaccgactactttgggtgtccgtgtttccttttattctcacattgactgcttatggtgacaattgaaagattgttaccatatagctattggattggtcatccggtgagcaatagagctattgtttatcaatttgttggatttgtaccactcaacttttctgttttgagaacactcaactacatcttactgctaaacacatcaaa

SEQ ID NO: 1056 - DNA, 743 bp, Echovirus
  E33, strain YNK35/CHN/2013, complete genome.1
ttaaaacagcctgtgggttgttcccacccacagggcccacgtggcgttagcacactggtatcccggtacctttgtgcgcctgttttatacaccccaaaccccaatgtaaattagaagaaaataacaccgatcaatagtgggtgtggcacaacagccacatcatgatcaagcactactgttcccccggactgagtatcaataagctgctcgcgcggctgaaggagaaaacgttcgttatccggccaattacttcgagaaacctagtaccaccatgaaggttgcgcagtgtttcgctccacacaaccccagtgtagatcaggtcgatgagtcaccgcattccccacaggcgactgtggcggtggctgcgctggcggcctgcccatggggtgacccatgggacgcttcaatactgacatggtgtgaagagtctattgagctaattggtagtcctccggcccctgaatgcggctaatcctaactgcggagcagatacccacgcaccagtgggtagtctgtcgtaacgggtaactctgcagtggaaccgactactttgggtgtccgtgtttccttttattctcacattggctgcttatggtgacaattgaaagattgttaccatatagctactggattggccatccggtgacaaacagagcaattgtgttcctcttcgatgggttcatacctctcaacaagatcagctttcgaactttgtgctacatcatcaagctaaacacaacaaa

SEQ ID NO: 1057 - DNA, 743 bp, Human echovirus
  25 mRNA for partial polyprotein (isolate TH222).1
ttaaaacagcctgtgggttgttcccacccacagggcccattgggcgctagcacactggtatcacggtacccttgtgcgcctgttttatccaccccccccttaacgtaacttagaagcataaatcaaatggtcaatagataacccagtatgccaactgggtcccgaccaagtacttctgttaccccggactgagtatcaataagctgcttacgtggctgaaggagaaaacgttcgttacccgaccaattacttcgagaaacctagtaacaccatgaaggttgcgcagtgtttcgctcaacacaaccccagtgtagatcaggtcgatgagtcaccgcgttccccacaggcgaccgtggcggtggctgcgttggcggcctgctcatggggcaacccatgagacgcttcaatactgacatggtgcgaagagtctattgagctaactggtagtcctccggcccctgaatgcggctaatcctaactgcggagcaggcgctcgcaaaccagtgagtagcctgtcgtaacgggtaactctgcagcggaaccgactactttgggtgtccgtgtttccttttattcttatattggctgcttatggtgacaattgagagattgttaccatatagctattggattggccatccggtgtctaacagagcaatcatttacctctttgttggttacgtaccattaaatcttaaggtcgtagcaacgcttaagtttatcctacttctcaacaaagcaaa

SEQ ID NO: 1058 - DNA, 743 bp, Unknown
  Description of Unknown: Human coxsackievirus B5 polyprotein gene, partial cds.1 sequence
ttaaaacagcctgtgggttgatcccacccacagggcccattgggcgctagcactctggtatcacggtacctttgtgcgcctgttttatatccctttcccttaattggaacttagaagttacacacaccgatcaacagcaggcgtggcatgccagctacgtcttgatcaagcacttctgtttccccggaccgagtatcaatagactgctcacgcggttgaaggagaaagtgttcgttacccggctaactacttcgagaaacccagtagcatcatgaaagttgcgaggtgtttcgctcagcacttccccagtgtagatcaggtcgatgagtcaccgcattccccacgggcgaccgtggcggtggctgcgttggcggcctgcctacggggcaacccgtaggacgcttcaatacagacatggtgcgaagagtcaattgagctagttagtattcctccggcccctgaatgcggctaatcctaactgcggagcacataccctcaatccagggggcattgtgtcgtaacgggtaactctgcagcggaaccgactactttgggtgtccgtgtttccttttgttcttatactggctgcttatggtgacaattgaaagattgttgccatatagctattggattggccatccattgtctaatagagctgttatatacctctttgttggttttgtaccgctcaatctaaaagaagttaagacactacaacttattatacagctgaacacagcaaa

SEQ ID NO: 1059 - DNA, 744 bp, Aichi virus
  genomic RNA, complete genome.1
tttgaaaagggggtgggggggcctcggccccctcaccctcttttccggtggtctggtcccggaccaccgttactccattcagcttcttcggaacctgttcggaggaattaaacgggcacccatactccccccaccccccttttgtaactaagtatgtgtgctcgtgatcttgactcccacggaacggaccgatccgttggtgaacaaacagctaggtccacatcctcccttcccctgggagggcccccgccctcccacatcctccccccagcctgacgtatcacaggctgtgtgaagcccccgcgaaagctgctcacgtggcaattgtgggtccccccttcatcaagacaccaggtctttcctccttaaggctagccccggcgtgtgaattcacgttgggcaactagtggtgtcactgtgcgctcccaatctcggccgcggagtgctgttccccaagccaaacccctggcccttcactatgtgcctggcaagcatatctgagaaggtgttccgctgtggctgccaacctggtgacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccacctccgggtgggatctgagcctgggctaattgtctacgggtagtttcatttccaatccttttatgtcggagtc

SEQ ID NO: 1060 - DNA, 744 bp, Human enterovirus sp.
  71, strain E2005125-TW polyprotein gene, complete1
ttaaaacagcctgtgggttgtacccactcacagggcccactgggcgtcagcactctggtactgaggtacctttgtgcgcctgttttaactcccttcccctgaagtaacttagaagcaataaactaacgatcaacagtgggcatgacataccagtcatgtctcgatcaagcacttctgtttccccggactgagtatcaataggctgctcgcgcggctgaaagagaaaacgttcgttacccggccagctacttcgagaagcttagtaccatcatgaacgaagcagagcgtttcgctcagcacaatcccagtgtagatcaggctgatgagtcactgcgacccccatgggcgaccatggcagtggctgcgttggcggcctgcccatggagaaatccatgggacgctctaattctgacatggtgcgaagagcctattgagctagctggtagtcctccggcccctgaatgcggctaatcctaactgcggagcacgcacccacaaaccagtgggcagtgtgtcgtaacgggtaactctgcagcggaaccgactactttgggtgtccgtgtttccttttattcttatattggctgcttatggtgacaatcaaagagttgttaccatatagctattggattggccatccggtgtgcaacagagcaattgtttacctatttattgggtttgtaccactaacgttgaagtctgtgaccacactcaactttatcctgaacctcaatacagtaaaac

SEQ ID NO: 1061 - DNA, 744 bp, Enterovirus sp.
  A71 Y90-3896 RNA, complete genome.1
ttaaaacagcctgtgggttgcacccacccacagggcccactgggcgccagcactctggtacttaggtacctttgtgcgcctgttttatctcccttcccccgaagtaacttagaagctgtgagctaacgatcaacagtaggtgtgacataccagtcatatcttgatcaagcacttctgtttccccggactgagtatcaataggctgctcgcgcggctgaaagagaaaacgttcgtcacccggccaactacttcgagaagcttagtaccaccatgaacgaggcagagtgtttcgctcggcacaaccccagtgtagatcaggctgatgagtcactgcaatccccatgggcgaccatggcagtggctgcgttggcggcctgcccatggagaaatccatgggacgctctaattctgacatggtgcgaagagcctattgagctagctggtagtcctccggcccctgaatgcggctaatcctaactgcggagcacacacccacaagccagtgggcagtgtgtcgtaacgggcaactctgcagcggaaccgactactttgggtgtccgtgtttccttttattcttgtattggctgcttatggtgacaatcaaagagttgttaccatatagctattggattggccatccggtgtgcaacagagcaattatttacctatttattggttttgtaccattgacactgaagtctgtgattacccttaattttattttgaccctcaacacagtcaaac

SEQ ID NO: 1062 - DNA, 744 bp, Unknown
  Description of Unknown: Human coxsackievirus A10, strain Kowalik, complete genome.1 sequence
ttaaaacagcctgtgggttgcacccactcacagggcccactgggcgctagcactctggtaccgtggtacctttgtgcgcctgttttatacccccttccccgtttgaacattagaagtaacgcacctcgatcagtagcaggcgcggcgcaccagccgtgtcttgatcaagcacttctgtttccccggaccgagtatcaatagactgctcacgcggttgaaggagaaaacgttcgttatccggctaactacttcgagaaacttagtagcaccatggaagttgcagagtgtttcgctcagcactccccccccagtgtagatcaggctgatggatcaccgcgttcctcacgggtgaccgtggcggtggtcgcgttggcggcctgcccatggggcaacccatgggacgctctaatatggacatggtgtgaagagtctattgagctagttagtagtcctccggcccctgaatgcggctaatcctaactgcggagcacgtgtccccaacccaggggatagcgtgtcgtaacgggtaactctgcagcggaaccgactactttgggtgtccgtgtttcctttattcttatcctggctgcttatggtgacaattgagagattgttaccatatagctattggattggccatccggtgtctaacagagctataatatatctttttgttgggttcgtacccctcaattttgaggttgttctcacattaaagtacatcttggtgttaaatatcagaag

SEQ ID NO: 1063 - DNA, 744 bp, Coxsackievirus
  A16, strain 12C10, complete genome.1
ttaaaacagcctgtgggttgtccccacccacagggcccactgggcgctagcacactgattttgcgggatctttgtgcgcctgttttataacccctccctaaacggcaatttagaagttctgcacatccacgaccagtagtaagcgtgacgcgccagtcacgtcttggtcaagtacttctgtatccccggactgagtatcaatagactgctcacgcggttgaaggagaaaacgttcgttatccggctaactacttcgagaaacctagtaacaccgtgaaagttgcggagtgtttcgctcagcacttcccccgtgtagatcaggccgatgagtcactgtaaaccccacgggcgaccgtgacagtggctgcgttggcggcctgcccatgaggcaactcatgggacgctctaatacagacatggtgtgaagagtctattgagctagttagtagtcctccggcccctgaatgcggctaatcctaactgcggagcacgcaccctcaacccagggggcggcgtgtcgtaatgggtaactctgcagcggaaccgactactttgggtgtccgtgtttccttttattccttattggctgcttatggtgacaattgaaaagttgttaccatatagctattggattggccatccggtatctaatagagctattgtttacctgttcattggatacgtccctcttagtcttaaggtcattcaaactcttgattacatattactccttaaccacaagaa

SEQ ID NO: 1064 - DNA, 744 bp, Enterovirus A71
  strain 119798, complete genome.1
ttaaaacaggctgtgggttgtacccactcacagggcctactgggcgctagcactctggcactaaggtacctttgtgcgcctgtttttacttccctttcccaaagaaacttagaagttgtgtaccaatgatcaatagcaggtgtgacgtacaaataacatcttgatcaatcacttctgtttccccggaccgagtatcaataggctgctcgcgcggctgaaggagaaaacgttcgttacccgaccagctatttcgagaagcttagtaccaccatgaacgaggcagagtgtttcgttcagcacaaccccagtgtagatcaggctgatgagtcactgcaacccccatgggcgaccatggcagtggctgcgttggcggcctgcccatggagaaatccatgggacgctctaattctgacatggtgtgaagagcctattgagctagctggtagtcctccggcccctgaatgcggctaatcctaactgcggagcacatgctcacgagccagtgggtggtgtgtcgtaatgggcaactctgcagcggaaccgactactttgggtgtccgtgtttccttttattcttatgttggctgcttatggtgacaatcaaagaattgttaccatatagctattggattggccatccggtgtgcaacagagcaattgtttatctatttattggtttcgtaccactatcactgaagtctgtgaccactctcgaattcattttgaccctcaactcaatcaaac

SEQ ID NO: 1065 - DNA, 744 bp, Enterovirus C96
  strain T49-XZ-CHN-2005, complete genome.1
ttaaaacagctctggggttgttcccaccccagaggcccacgtggcggccagtacaccggtatcacggtacccttgtacgcctgttttatactccctaccccgtaacttagaagcatcaactcaagttcaatagtaggggtacaatccagtaccaccacgaacaagcacttctgtttccccggtgatattgtatagactgtgcccacggttgaagacaatagatccgttatccgcttttatacttcgagaagcccagtaccaccttggaatcttcgatgcgttgcgatcagcactcgaacccggagtgtagcttaggtcgatgagtctggacgctcctcaccggcgacggtggtccagactgcgttggcggcctacctgtggcccaaagtcacaggacgctagttgtgaacaaggtgtgaagagcctattgagctataaaagagtcctccggcccctgaatgcggctaatcccaaccacggagcaggtgatcacaaaccagtgactagcctgtcgtaacgcgcaagtctgtggcggaaccgactactttgggtgtccgtgtttccttttatttcatttatggctgcttatggtgacaatcatagattgttatcataaagcgaattggattggccatccggtgaaaatcaagcacatcatttatctgtttgttggatttacacctttagtttcttactccccgcgccttattcatattgtgttgttgattagacagtggtattacc

SEQ ID NO: 1066 - DNA, 744 bp, Human enterovirus 96
  strain 05517, complete genome.1
ttaaaacagctctggggttgttcccaccccagaggcccacgtggcggccagtacaccggtatcacggtacccttgtacgcctgttttatactccccgcccgtaacttagaagcaataactcaagttcaacagcagggggtacaaaccagtacctccacgaacaagcacttctgtttccccggtgacattgtatagactgtacccacggttgaaaacaatagatccgttatccgcttttgtacttcgagaagcccagtaccgtcttggaatcttcgatgcgttgcgctcagcactcgaacccggagtgtagcttaggtcgatgagtctggacagtcctcaccggcgacggtggtccaggctgcgttggcggcctacctgtggcccaaagccacaggacgctagttgtgaacaaggtgcgaagagcctattgagctacagaagagtcctccggcccctgaatgcggctaatcccaaccatggagcaggtgatcacgaaccagtgattagcctgtcgtaatgcgcaagtctgtggcggaaccgactactttgggtgtccgtgtttccttttatttcatttatggctgcttatggtgacaatcatagattgttgtcataaagcgaattggattggccatccggtgaaagtcaaacacattgtttatttgtttgttggcttcacgcctttaacttatcacaccttaaacctcattcacattaccttgttgatcagacagtggtatcacc

SEQ ID NO: 1067 - DNA, 744 bp, Unknown
  Description of Unknown: Human coxsackievirus A18, strain G13, complete genome.1 sequence
ttaaaacagctctggggttgttcccaccccagaggcccacgtggcggccagtactccggtattgcggtacccttgtacgcctgttttacactcccttccccgtaacttagacgcaataaaccaagttcactaggaggggtgcaaaccagcaccaccacgaacaagcacttctgtttccccggtgacattgtatagactgtatccacggttgaaaacgattgatccgttatccgctcttgtacttcgagaagcctagtatcatcttggaatcttcgacgcgttgcgctcagcattcaaccccagaatgtagcttaggtcgatgagtctggacattcctcaccggtgacggtggtccaggctgcgttggcggcctacctgtgacccaaagtcacaggacgctagttgtgaacaaggtgtgaagagcctattgagctacaagagagtcctccggcccctgaatgcggctaatcctaaccacggagcaagtgctcacgaaccagtgagtggcttgtcgtaacgagcaattctgtggcggaaccgactactttgggtgtccgtgtttcctttttaactttaaatggctgcttatggtgacaatcattgattgttatcataagccgaattggattggccatccggtgaaaatcaagttgatcatttatttgtttgttggattcactccattaactcatttttcaattgacctaatacgtattgtattattagttagaaacatacatcaca

SEQ ID NO: 1068 - DNA, 744 bp, Unknown
  Description of Unknown: Human coxsackievirus A24, strain E34-dn19 polyprotein gene, complete1 sequence
ttaaaacagctctggggttgttcccaccccagaggcccacgcggcggccagtacaccggtatcacggtacccttgtacgcctgttttatactcccttccccgtaacttagaagccacaaaccaagttcgataggagggggtacaaaccagtaccaccgtgaacaagcacttctgtttccccggtgatgtcacatagactgtccccacggttgaaagtgattgatccgttacccgccttggtacttcgagaaacctagtatcatcttggaatcaatgacgcgttgcgctcagcactcaaacccggagtgtagcttaggctgatgagtctggacgtccctcactggcgacagtggtccaggctgcgctggcggcctacctgtggtggaagccacaggacgctaattgtgaacaaggtgtgaagagtctattgagctaccatggagtcctccggcccctgaatgcggctaatcccaaccacggagcaagtattcacaaaccagtgaaatgcttgtcgtaacgcgaaagtctgtggcggaaccgactactttgggtgtccgtgtttccttttattctttatatggctgcttatggtgacaatcatagattgttatcataaagcgcattggattggccatccggtgaaaatcaagcaaatcatttacttatttgttggatttactccaatcacaccatttacattgcatttaattactcttgtgttgacaatcagaagatactaccaca

SEQ ID NO: 1069 - DNA, 744 bp, Unknown
  Description of Unknown: Human coxsackievirus A11, strain BAN00-10444, complete genome.1 sequence
ttaaaacagcctgtgggttgttcccaccccagaggcccacgtggcggctagtactctggtatcacggtacctttgtacgcctgttttataccccttccccaagtaaccttagaagcaactcaacaagttcaatagagggggtacaaaccagtaccaccacgaacaagcacttctgtttccccggtgattttgcataggctgtacccacggccaaaagtgaatgatccgttatccgcttgagtacttcgagaagcttagtaccaccttggaatcttcgatgcgttgcgctcagcactctaccccgagtgtagcttaggctgatgagtctgggcattccccaccggcgacggtggcccaggctgcgttggcggcctacccatggctaacgccatgggacgctagttgtgaacaaggtgtgaagagcctattgagctactcaagagtcctccggcccctgaatgcggctaatcctaaccatggagcaagtgccctcaacccagagggtggcttgtcgtaacgcgcaagtccgtggcggaaccgactactttgggtgtccgtgtttccttttatcttatatatggctgcttatggtgacaatcatagattgttatcataaagcgaattggattggccatccggtgaagtataaacatattatttacctgtttgtcggattcaccccgctcactttatacacacccaatatagtatctattgtactgctactgaggcactaccaccgca

SEQ ID NO: 1070 - DNA, 744 bp, Human enterovirus sp.
  88, strain BAN01-10398, complete genome.1
ttaaaacagcctgtgggttgatcccacccacagggcccactgggcgctagcacactggtattccggtacttttgtgcgcctgttttatacacccttccccttcatgtaacttagaagtaaaacacaaacggtcaataggtagctcagcaaaccagctgagcctcggccaagcacttctgttaccccggactgagtatcaataagctgttaacacggctgaaggagaaaacgttcgttatccggccaattacttcgagaaacctagtaacaccatgaaggttgcgtagcgtttcgctccacacaaccccagtgtagatcaggtcgatgagtcaccgctctccccacgggtgaccgtggcggtggctgcgttggcggcctgcccatggagcactccatgggacgcttcaatactgacatggtgtgaagagtctattgagctaattggtagtcctccggcccctgaatgcggctaatcctaactgcggagcagacacccacacgccagtgggcagtctgtcgtaatgggcaactctgcagcggaaccgactactttgggtgtccgtgtttccttttattcttacattggctgcttatggtgacaatcaaggaattgttaccatatagctattggattggccatccggtatctaacagagcaattgtttacctcttcaccggttttgtaccattgaattgcaatagtctcaacaccctttgctatatcattaaattgaactcagcaaa

SEQ ID NO: 1071 - DNA, 744 bp, Human echovirus
  30, strain Kor08-ECV30, complete genome.1
ttaaaacagcctgtgggttgctcccacccacagggcccactgggcgctagcacactggtatcccggtacctttgtgcgcctgttttatccaccccacccccagctgtaatttagaagttcgacacacatggtcaatagatggctcagtgcaccaactgggtttagaccaagcacttctgttaccccgggccgagtatcaataagctgctcgcgcggctgaaggagaaaacgctcgttatccggccaattacttcgagaaacctagtaccaccatggaggttgcgcagcgtttcgctccgcacagccccagtgtagatcaggccgatgagtcaccgcgttcctcacgggcgaccgtggcggtggctgcgttggcggcctgcccatggggcaacccatgggacgcttcaatactaacatggtgtgaagagtctattgagctaattggtagtcctccggcccctgaatgcggctaatcctaactgcggagcagatactcacatgccagtgggcagtctgtcgtaacgggcaactctgcagcggaaccgactactttgggtgtccgtgtttccttttattcttatactggctgcttatggtgacaattgagaaattgttaccatatagctattggattggccatccagtgacaaacagagcgattgtttacctatttgtcggtttcataccgttgaactttagagttttgaagaccctcaacttgattatattattcaactctgtaaa

SEQ ID NO: 1072 - DNA, 744 bp, Echovirus
  E11, strain 1315/ISR/1999, complete genome.1
taaaacagcctgtgggttgttcccacccacagggcccactgggcgccagcactctggtattatggtaccttagtgcgcctgttttatacaccccttccccaaatgtaatttagatgcatgtaaacaaaggccaatagcaggcgcagcataccagctgtgtctcggtcaagcacttctgttaccccggactgagtatcaataggctactcacgtggctgaaggagaaaacgttcgttatccggccaattacttcgagaaacctagtaataccatgaaggttgcgaagtgtttcgctcagcacaaccccagtgtagatcaggtcgatgagtcaccgcattccccacgggtgaccgtggcggtggctgcgctggcggcctgcccatgggattacccatgggacgcttcaatattgacatggtgtgaagagtctattgagctaattggtattcctccggcccctgaatgcggctaatcccaactgcggagcaggtacccacatgccagtgggcagcctgtcgtaatgggcaactctgcagcggaaccgactactttgggtgtccgtgtttctctttattcttatactggctgcttatggtgacaattgagaaattgttgccatatagctattggattggccatccggtgacaaatagagcaattgtgcatccatttgttggttttatactaactcaatctcaaagttttaactaccctcaatctcattatatcattcaatacagcaaa

SEQ ID NO: 1073 - DNA, 744 bp, Echovirus
  E3 genomic RNA, complete genome,strain: OC10-532.1
ttaaaacagcctgtgggttgttcccacccacagggcccactgggcgttagcactctggtatcacggtacctttgtgcgcctgttttatctaccctccctaaaaatgtaatttagaagcatgatccgaacggtcattaggtagctcagtgcaccaactgagcccagaccaagcacttctgttaccccggactgagtatcaataggctgctcgcgcggctgaaggagaaaacgttcgttatccggccaattacttcgagaaacccagtaccactatgaaagttgcgcagcgtttcgttccgcacaaccccagtgtagatcaggtcgatgagtcaccgcgttccccacgggcgaccgtggcggtggctgcgttggcggcctgctcatggggcaacccatgagacgcttcaatactgacatggtgcgaagagtctattgagctaattggtagccctccggcccctgaatgcggctaatcccaactgcggagcagatacccacaaaccagtgggcagtctgtcgtaatgggtaactctgcagcggaaccgactactttgggtgtccgtgtttccttttgttcttacactggctgcttatggtgacaattgagagattgttgccatatagctattggattggccatccggtgactaacagagcaattgtttacttatttgttggttttataccgttagattacaaagtcctaaacaccctgaatctcattataacacttaattcagcaaa

SEQ ID NO: 1074 - DNA, 744 bp, Enterovirus
  B75,isolate 102/SD/CHN/97, complete genome.1
tttaaaacagcctgtgggttgtttccacccacagggcccacagggcgctagcactttggtatcacggtacctttgtgcgcctgttttataacccttcccccccacagaaacttagaagcaccacacaccgatcaatagaaagcgtggcgcaccagccatgtcttgatcaagcacttctgtttccccggaccgagtatcaatagactgctcgcgcggtcgaaggagaaaacgtccgttatccggctgactacttcgagaaacccagtaacaccatggaaattgcggagtgtttcgatcagcacatccccagtgtagatcaggtcgatgagtcaccgcattccccacgggtgaccgtggcggtggctgcgttggcggcctgcctacggggcatcccgtaggacgcttcaaaatggacatggtgcgaagagtctattgagctagtcagtagtcctccggcccctgaatgcggctaatcctaactgcggagcgcgcgcctccaacccagggggtagcgcgtcgtaacgggtaactctgcagcggaaccgactactttgggtgtccgtgtttctttttatcattacattggctgcttatggtgacaattgaaaggttgttaccatatagctattggattggccacccggtgtctaatagagcgattgtgtacctttttgttgggtttgtgccactttgtaaaacagcctatcagactttgtgctttatagtcaaactaaatacagcaaa

SEQ ID NO: 1075 - DNA, 744 bp, Echovirus
  E30, strain 13-759, complete genome.1
ttttaaaacaagctgtgggttgatcccacccacagggcccactgggcgctagtacactggtatcacggtacctttgtgcgcctgttttacctacccctccccgaaagaaacttagaagctcaacttatgtggtcaatagtaagctcagtacgccaactgagccacgaccaagcacttctgtcgccccggactgagtatcaataagctgctcacgtggctgaaggagaaaacgttcgttatccggccaattacttcgagaaacccagtaccaccatgaaagttgcgcggcgtttcgctccgcacaaccccagtgtagatcgggccgatgagtcaccgcgttccccacgggcgaccgtggcggtgactgcgttggcggcctgcccatggagcaatccatgggacgcttcaatactgacatggtgcgaagagtctattgagctaattggtagtcctccggcccctgaatgcggctaatcctaactgcggagcagatacccacacaccagtgggcagtctgtcgtaacgggcaacttcgcagcggaaccgactactttgggtgtccgtgtttccttttattttatactggctgcttatggtgacaattgagagattgttaccatatagctattggattggccatccggtgtccaacagagcgatcatttacttgtttgttggattcgtgcccttgaactacaaagcactcctaacacttaaatacattgtagacctcaacacagcaaa

SEQ ID NO: 1076 - DNA, 744 bp, Human enterovirus sp.
  85,strain HTPS-MKLH04F/XJ/CHN/2011, complete1
ttaaaacagcctgtgggttgttcccacccacagggcccactgggcgctagcacactggtattacggtacctttgtgcgcctgttttatataccccccccaagtgcaacttagaagcaagacatgaccggtcagcaggtgattcagtaaaccaactgagtcttgaccaagcacttctgtttccccggaccgagtatcaataggctgcttacgcggctgaaggagaaagtgttcgttacccggccaattacttcgagaagcctagtaccaccatggaggttgcgcggcgtttcgctccgcacacccccagtgtagatcaggccgatgagccaccgcattccccacgggtgaccgtggcggtggctgcgttggcggcctgcccatggggtaacctatgggacgcttcaatactgacatggtgcgaagagcctattgagctaattggtagtcctccggcccctgaatgcggctaatcctaactgcggagcaggtacccacataccagtgggcagcctgtcgtaacgggtaactctgcagcggaaccgactactttgggtgaccgtgtttccttttattttttcctattggctgcttatggtgacaatcgaggaattgttgccatatagctattggattggccatccggtgtcaaatagagcgattatttacctgtttgttggatttgtaccactgaactttaaggcgctcatcactctcaactatattttatcccttaacgcaacaaa

SEQ ID NO: 1077 - DNA, 744 bp, Human enterovirus sp.
  84, isolate CIV2003-10603, complete genome.1
ttaaaacagcctgtgggttgttcccacccacagggcccaccgggcgccagcacactggtatcacggtacccttgtgcgcctgttttatccaccccttcccacagtaacttagaagcacaccatgtatacggtcaataggcggctcagtacaccaactgggccacgaccaagcacttctgttaccccggactgagtatcaataagctgctcacgcggctgaaggagaaaacgttcgttacccggccaattacttcgagaaacccagtaccaccatgaaggttgcgcagcgtttcgttccgcacaaccccagtgtagatcaggtcgatgagtcaccgcgttcctcacgggtgaccgtggcggtggctgcgttggcggcctgcccatggggcaacccatgggacgcttcaatactgacatggtgcgaagagtctattgagctaattggtagtcctccggcccctgaatgcggctaatcctaactgcggagcagatacccacaaaccagtgggcagtctgtcgtaacgggcaactctgcagcggaaccgactactttgggtgtccgtgtttccttttatccttacactggctgcttatggtgacaattgagaaattgttaccatatagctattggattggccatccggtgacaaacagagcagttgtttacctatttgttggtttcgtaccgctgaaccttaaagttctaaagaccctcaattttatcttagcacttaacacagcaaa

SEQ ID NO: 1078 - DNA, 744 bp, Enterovirus sp.
  C96 clone V13C polyprotein gene, complete cds.1
ttaaaacagctctggggttgttcccaccccagaggcccacgtggcggccagtacaccggtattacggtacccttgtacgcctgttttatactcccttccccgcaacttagaagttaaacaaaccaagttcaatagaagggggtgcaaaccagtaccaccacgaacaagcacttctgtttccccggtgacgtcatataggttgtaaccacggccaaaagtgactgatccgttatccgctcttgtacttcgagaagcccagtaccatcttgggatcttcgatgcgttgcgctcagcactcgaacccggagtgtagcttaggccgatgagtctggacattccccaccggtgacggtggtccaggctgcgttggcggcctacctgtggtccaagccacaggacgctagatgtgaacaaggtgtgaagagcctattgagctacaagggaatcctccggcccctgaatgcggctaatcctaactacggagcagacggtcacaaaccagtgaatggtctgtcgtaatgcgcaagtctgtagcggaaccgactactttgggtgtccgtgtttccttttatctttttaatggctgcttatggtgacaatcctagattgttatcataaagcgatttggattggccatccagtgatatttgaaaccattactgtattgcctgctaaggctattttaaagacttaataaacacaacttcattcaactcaattacaccaactaacaactgtctcata

SEQ ID NO: 1079 - DNA, 744 bp, Human enterovirus sp.
  B,strain Cuba450of90 polyprotein gene, complete1
tttaaaacagcctgtgggttgttcccacccacagggcccactgggcgctagcactctggtattacggtacctttgtgcgcctgttttacatccctcccccagatgcaacttagaagcagtacaccaagaccaatagtaggcatggcataccagccatgtgtcggtcaagcacttctgttcccccgggctgagtatcaataaactgctcacgtggttgaaggagaaagcgcccgttacccggctaactacttcgagaagcctattaacaccatgaaagttgcggagtgtttcgctcagcacgatcccggtgtagatcaggccgatgagtcaccgcgttccccacaggtgactgtggcggtggctgcgttggcggcctgcccatggggcaacccatgggacgcttcaatatggacatggtgtgaagagcccattgagctagttagtagtcctccggcccctgaatgcggctaatcccaactgcggagcacagcgcccccgctccagggggtagtgtgtcgtaacgggcaactctgcagcggaaccgactactttgggtgtccgtgtttccttttttccttttcattggctgcttatggtgacaattgaaagattgttaccatatagctattggattggccatccagtgtcaagcagagctataatttaccaatttatagggtttgtcccgttggatctgaaagctttaaaaacccttaacttggtactactattaaacagtgtaaa

SEQ ID NO: 1080 - DNA, 744 bp, Echovirus
  E20,strain 812/YN/CHN/2010, complete genome.1
ttaaaacagcctgtgggttgttcccacccgcagggcccactgggcgctaccacactggtattaaggtacccttgtgcgcctgtttaatacacccctccccctaatgtaacttagaagcatgacttaagtggtcaatagatagctcagtaatccaactgagttccgaccaagtacttctgttaccccggaccgagtatcaataagctgttcacgcggcagaaggagaaagcgttcgttatccggccaattacttcgagaaacccagtatcaccatgaaagttgcgcagtgtttcgctccgcacaaccccagtgaagatcaggtcgatgagtcaccacagtcctcacgggcgaccgtggtggtggctgcgttggcggcctgcccatggggcaacccctgggacgcttcaatcctgacatggtgtgaagagtctattgagctggatggtatccctccggcccctgaatgcggctaatcctagctgcggagcagacgctcgcatgccaacgggtagtctgtcgtaccgggtaactctgcagcggaaccgactactttgggtgtccgtgtttccttttatccttatatcgcctgcttatggtgtcaattgaaagattgttaccatatagctaatggattggccatccgataacaaatagagtgattatctagttttttgttggatttgttccattgaactacaaggtattgaacacccttaatttcattttaacactcaacacaacaaa

SEQ ID NO: 1081 - DNA, 744 bp, Enterovirus sp.
  B83, isolate AFP341-GD-CHN-2001, complete genome.1
tttaaaacagcctgtgggttgttcccacccacagggcccactgggcgctagcactctggtatcacggtacctttgtgcgcctgttttatagcccctcccttagataggaatttagaagcactgcacaccgatcaatagcaggcgcggcacgccagccacgtcttgatcaagcacttctgtttccccggaccgagtatcaatagactgttaacgcggtcgaaggagaaaacgttcgttatccggccaactacttcgagaaacctagtaacgccatggaagttgcggagtgtttcgctcagcacatccccagtgtagatcaggtcgatgagtcaccgcatccctcacgggtgaccgtggcggtggctgcgttggcggcctgcctacggggcaacccgtaggacgcttcaatatggacatggtgcgaagagtatattgagctagttggtagtcctccggcccctgaatgcggctaatcctaactgcggagcgctcgcccccaatccagggggtcgtgcgtcgtaacgggtaactctgcagcggaaccgactactttgggtgtccgtgtttccttttatctttatcacggctgcttatggtgacaattgaaagattgttaccatatagctattggattggccatcctgtgtctaacagagcaatcatatatctttttgttggatttgtgccacttgataaaataagttaccagactttgtgttttatcatcagactaaacacaacaaa

SEQ ID NO: 1082 - DNA, 744 bp, Echovirus
  E7, strain DH22G/JS/2012, complete genome.1
ttaaaacagcctgtgggttgtacccacccacagggcccaccgggcgctagcacactggtatcacggtacccttgtgcgcctgttttatcaacccctccccacattgaaacttagaagtaacacacaccgatcaatagtgggcgtggcaaaccagctacgtcgtgatcaagtatttctgtttccccggactgagtatcaatagactgctcgcgcggttgaaggagaaaacgttcgttacccggctaactacttcgagaaacctagtaatgccatgaaaattgcgtagcgtttcgttcagcacaaccccagtgtagatcaggtcgatgagtcactgcattcctcacgggcgaccgtggcagtggctgcgttggcggcctgcctatagggtaacctataggacgctacaatatggacatggtgtgaagagtctattgagctagttagtagtcctccggcccctgaatgcggctaatcctaactgcggagcgcgtgtttccaatccaggaagtggcgcgtcgtaatgggcaactctgcagcggaaccgactactttgggtgtccgtgtttctcttttatccttacactggctgcttatggtgacaattgaagaattgttaccatatagctattggattggccatccggtgtctaatagagcaattgtatacctctttgttggatttataccattaaacagaacaagttaccagaccctgtgctttattgttaaactaaacacgacgaa

SEQ ID NO: 1083 - DNA, 744 bp, Coxsackievirus
  B3, isolate DH16G/JS/2012, complete genome.1
tttaaaacaaagctgtgggttgttcccacccacagggcccactgggcgctggcacactggtattgcggtacctttgtgcgcctgttttatccgccctccccagtagtaacctagaagcatgaataatgtggtcaataggaagctcagtaaaccaactgggtcttgaccaagcacttctgttaccccggactgagtatcaagaagctgctcgcgtggctgaaggagaaaacgttcgttacccggccaattacttcgagaaacccagtaccaccatggaagttgcgcagcgtttcgctccgcacaaccccagtgtagatcaggtcgatgagtcaccgcaatcctcacgggtgaccgtggcggtggctgcgctggcggcctgcccatggggtaacccatgggacgcttcaatactgacatggtgcgaagagtccattgagctaattggtagtcctccggcccctgaatgcggctaatcctaactgcggagcagatatccacacaccagtggacagtctgtcgtaatgggtaactctgcagcggaaccgactactttgggtgtccgtgtttccttttatctttatattggctgcttatggtgacaattgagagattgttaccatatagctattggattggccatccggtgagcaacagagcaattgtattcctctttgtaggatttgtgccgttgaattacaacaactacaacaccttactctacattatccacttaaacacgcggaa

SEQ ID NO: 1084 - DNA, 744 bp, Echovirus E3
  isolate ECHO3_INMI1 polyprotein gene, complete cds.1
ttaaaacaaggctgtgggttgtacccgcccacagggcccactgggcgccagcactctggtattacggtacccttgtgcgcctgttttatatcccttccccaaggtaaacgttagaagcaatgcactcccgatcaatagaaggtgcgacgcgccagtcgtatctcgatcaagcacttctgtttccccggaccgagtatcaatagactgctagcgcggttgaaggagaaaacgttcgttacccgactaactacttcgagaagcccagtagcgccatgaaagttgcagagtgtttcgctcagcacttcccccgtgtagatcaggccgatgagtcaccgcaatccccacgggcgaccgtggcggtggctgcgttggcggcctgcctatggggaaacccataggacgctcaaatacagacatggtgcgaagagtctattgagctagttagtactcctccggcccctgaatgcggctaatcctaactgcggagcaagtactcacaatccagtgggcagcttgtcgtaacgggtaactctgcagcggaaccgactactttgggtgtccgtgtttccttttattcctacattggctgcttatggtgacaatcaaagagttgttaccatatagctattggattggccatccggtgactaataaagcaattatatttctttttgttgggtttgtaccccttaatacaaccagcttcaccacattgtgttacatcattagactgaacaaggcaaa

SEQ ID NO: 1085 - DNA, 744 bp, Echovirus
  type 30 partial ORF1 gene for polyprotein,isolate 91TLC.1
ttaaaacagcctgtgggttgttcccacccacagggcccactgggcgccagcacactggtatcacggtacttttgtgcgcctgttttatctacccccacccccagcgtaacttagaagcacatttcacacggtcaataggtgactcagcatgccagctgagttttggccaagcacttctgttaccccggaccgagtatcaataagctactcacgtggctgaaggagaaagcgttcgttaaccggccaattacttcgagaaacctagtatcaccatgaaggttgcgtggcgtttcgctccgcacaaccccagtgtagatcaggtcgatgagttaccgcgtccctcacgggcgaccgtggcggtagctgcgctggcggcctgcccatggggcaacccatgggacgcttcaatactgacatggtgtgaagagtctattgagctaattggtagtcctccggcccctgaatgcggctaatcctaactgcggagcagatacccacacgccagtgggcagtctgtcgtaatgggcaactctgcagcggaaccgactactttgggtgtccgtgtttccttttactcttatattggctgcttatggtgacaattaaaagattgttaccatatagctattggattggccatccagtgtctaatagagcgatcatttacctttttcttgggtttgttccactcaactataaagcacttgtaacgctcaaatatattataaacctcaacacaacaaa

SEQ ID NO: 1086 - DNA, 745 bp, Human enterovirus sp.
  91 polyprotein gene, complete cds.1
ttaaacagctctagggttgttcccaccctagaggcccacgtggcggctagcactctggtatcacggtacctttgtgcgcctgttttatatccctttccccatgtaacttagaagttattaaacaaagttcaatagaagggggtacaaaccagtgccaccacgaacaagcacttctgtttccccggtgaagctgtatagactgtctccacggttgaaaatggcagatccgttacccgctttggtacttcgagaaacctagtatcaccttggaatcttcgatgcgttgcgctcagcactcaaccccagagtgtagcttaggtcgatgagtctggacgatcctcactggtgacagtggtccaggctgcgttggcggcctacctgtggtgaaaaccacaggacgctagttgtgaacaaggtgtgaagagtctattgagctaccaaagagtcctccggcccctgaatgcggctaatcctaaccacggagcaagtgccttcaaaccagtaggtagcttgtcgtaacgcgcaagtctgtggcggaaccgactactttgggtgtccgtgtttccttttattttatcatggctgcttatggtgacaatctaagattgttatcatatagctattggattggccatccggtgactaacagagatctcatatacctttttgttggttttactaaattaaatattaccacgttcaagacacttctccttatcatacaactaaatagtgagaagagaaa

SEQ ID NO: 1087 - DNA, 745 bp, Coxsackievirus
  A16,strain 20692_88_CV-A16 polyprotein gene,1
ttaaaacagcctgtgggttgtacccacccacagggcccactgggcgttagcacactgatttcacggaatctttgtgcgcctgttttatatccctcccccaatacagtaacttagaagttagaaacctacacgaccaatagcaggcgtgacgcaccagtcatgtcttggtcaaacacttctgtttccccggactgagtatcaataagccgctcacgcggctgaaggagaaaacgttcgttatccggctaactacttcgagaaacctagtagcaccgtgaaagttgcagagtgtttcgctcagcactttccccgtgtagatcaggtcgatgagtcactgcatcccccacgggcgaccgtggcagtggctgcgttggcggcctgcctatggggcaacccatgggacgctctaatacagacatggtgtgaagagtctattgagctagttagtagtcctccggcccctgaatgcggctaatcctaactgcggagcacgcaccctcaatccagggggcggcgtgtcgtaacgggtaactctgcagcggaaccgactactttgggtgtccgtgtttccttttatcacttactggctgcttatggtgacaatcaaagaattgttaccatatagcttttggattggccatccggtgtctaacagagctattgtttacctgtttgttggatacattcctctcaactacaaagttcttcaaactctcaactttatattgctccttaatcataagaa

SEQ ID NO: 1088 - DNA, 745 bp, Human enterovirus sp.
  71, strain 804/NO/03, complete genome.1
ttaaaacagcctgtgggttgcacccacccacagggcccactgggcgtcagcactctggtactgaggtacctttgtgcgcctgtttttacttccctttcccgaaagtaacttagaagctttgaaccagcgatcaacagtaggtgtgacataccagtcacatctcgatcaagcacttctgtatccccggactgagtatcaataggctgcttacgcggctgaaagagaaaacgttcgttacccggccaactacttcgagaagcttagtaccaccatgaacgaggcagagcgtttcgctcggcactaccccagtgtagatcaggctgatgagtcactgcaatccccatgggcgaccatggcagtggctgcgctggcggcctgcccatggagagatccatgggacgctctaattttgacacggtgcgaagagcctattgagctagttggtagtcctccggcccctgaatgcggctaatcctaactgcggagcgcacacccacataccagtgggtagtgtgtcgtaacgggcaactctgcagcggaaccgactactttgggtgtccgtgtttccttttattctcatgtcggctgcttatggtgacaatcgaagagttgttaccatatagctattggattggccatccggtgtgcaacagagcaattgtctaccagtttattggttttgtaccactgacattaaagtctgtaattaccctcaattttatcttgacccttaacacggtcaagc

SEQ ID NO: 1089 - DNA, 745 bp, Coxsackievirus
  A16,strain R35/YN/CHN/2012, complete genome.1
ttaaaacagcctgtgggttgttcccacccacagggcccactgggcgctagcacactgattctgcgggatctttgtgcgcctgttttataacccttcccctaggtagcaactttgaaggtttggacaaaaacgaacaatagggggcgaaaagcgccagtcacgtcttggtcaaacacttctgtatccccggactgagtaccaataggctgctcacgcggttgaaggggaaaacgttcgttacccggctaactacttcgagaaacctagtaacaccatgaaagttgcggagtgtttcgctcagcacttcccccgtgtagatcaggtcgatgagtcactgtaaaccccacgggcgaccgtgacagtggctgcgttggcggcctgcccatggggtaacccatgggacgctctaatacagacatggtgcgaagagtctattgagctagttagcagtcctccggcccctgaatgcggctaatcctaactgcggagcgcgcaccctcaatccagggggcggcgtgtcgtaatggttaactctgcagcggaaccgactactttgggtgtccgtgtttccttttattctttattggctgcttatggtgacaattgaaaagttgttaccatatagctattggattggccatccggtgtctaacagagctattgtttacctatttattggatacgtccctctcaatctcaagtccattcaaactcttgattatatattgctccttaactgtaggaa

SEQ ID NO: 1090 - DNA, 745 bp, Coxsackievirus
  A16,isolate CV-A16-M02-BLR-IN, complete genome.1
ttaaaacagcctgtgggttgttcccacccacagggcccattgggcgatagcacactgattttgcggaatctttgtgcgcctgttttataacccttcccccaagcagcaacttagaagtattgcacaatcgcggccagtagtgggcgtgacgcgccagtcacgtcttggtcaagcacttctgtatccccggactgagtatcaatagactgctcacgcggttgaaggagaaaacgttcgttatccggctaactacttcgggaaacctagtagcaccttgaaagttgcagagtgtttcgctcagcacttcccccgtgtagatcaggccgatgagccactgtaaaccccacgggcgaccgtgacagtggctgcgctggcggcctgcccatgggggaacccatgggacgctctaatacaaacatggggtgaaaagtctactgagctacttagtagtcctccggcccctgaatgcggctaatcctaactgcagagcacacaccctcaaccctcggggcagtgtgtcgtaatgggtaactctgcagaggaacccactactttgggtgaccgtgtttccttttattcgttattggctgcttagggcgacaattgaaaagttgttaccatatccctattgtattggccatccggtatctaacagagctattgtttacttatttgttggatacgtccctcttaatttcaaggctatccaaactcttgattatatatcgctccttaattataagaa

SEQ ID NO: 1091 - DNA, 745 bp, Coxsackievirus
  A16 gene for polyprotein,isolate1
ttaaaacagcctgtgggttgttcccacccacagggcccactgggcgctagcactctgattttgcgggatctttgtgcgcctgttttataatcccttccctaagcagtaacttagaagttctacacaatcaggaccaacagtcagcgtggcacgccagccacgttttggtcaagcacctctgtttccccggactgagtatcaatagactgctcacgcggttgaaggagaaaacgttcgttacccggctaactacttcgagaaacctaatagcaccatgaaagttgcggagtgtttcgctcagcacttcccccgtgtagatcaggtcgatgagtcactgtaaaccccacgggcgaccgtgacagtggctgcgttggcggcctgcccatggggtaacccatgggacgctctaatacggacatggtgtgaagagtctattgagctagttagtagtcctccggcccctgaatgcggctaatcctaactgcggagcatgcgccctcaacccagggggtggcatgtcgtaatgggcaactctgcagcggaaccgactactttgggtgtccgtgtttccttttattcctcattggctgcttatggtgacaattgaaaggttgttaccatatagctattggattggccatccggtgtctaacagagctattgtttacctattcattgggtttgtccctcttaatcttaagaccatccaaactcttgattacatattgctcctcaattgtagaag

SEQ ID NO: 1092 - DNA, 745 bp, Unknown
  Description of Unknown: Human coxsackievirus A12,strain Texas-12, complete genome.1 sequence
ttaaaacagcctgtgggttgtacccacccacagggcccactgggcgctagcactctggtactacggtacctttgtgtgcctgttttaagcccctaccccccactcgtaacttagaaggcttctcacactcgatcaatagtaggtgtggcacgccagtcacaccgtgatcaagcacttctgttaccccggtctgagtaccaataagctgctaacgcggctgaaggggaaaacgatcgttatccggctaactacttcgagaaacccagtaccaccatgaacgttgcagggtgtttcgctcggcacaaccccagtgtagatcaggtcgatgagtcaccgtattccccacgggcgaccgtggcggtggctgcgttggcggcctgcccatggggtgacccatgggacgctctaatactgacatggtgcgaagagtctattgagctagttagtagtcctccggcccctgaatgcggctaatcctaactgcggagcacatacccttaatccaaagggcagtgtgtcgtaacgggcaactctgcagcggaaccgactactttgggtgtccgtgtttccttttattcttacattggctgcttatggtgacaattgaaaagttgttaccatatagctattggattggccatccggtgacaaatagagctattgtatatctttttgttggttacgtaccccttaattacaaagtggtttcaactttgaaatacatcctaacactaaattgtagaaa

SEQ ID NO: 1093 - DNA, 745 bp, Enterovirus sp.
  C96,isolate JN13048, complete genome.1
ttaaaacagcctgtgggttgttcccaccccagaggcccacgtggcggctagtacaccggtatcgcggtacccttgtacgcctgttttatactccctaccccgtaacttagaagcaataacttgagttcaacagcagggggtacaaaccagtaccaccacgaacaagcacttctgtttccccggtgacgttgtatagactgtacccacggtcgaaaacaatagatccgttatccgcttttgtacttcgaaaagcccagtaccatcttggaatcttcgatgcgttgcgttcagcactcgaacccggagtgtagcttaggtcgatgagtctggacagtccacaccggcgacggtggtccaggctgcgttggcggcctacctgtggcccaaagccacaggacgctagttgtgaacaaggtgtgaagagcctattgagctacaaaagactcctccggcccctgaatgcggctaatcccaaccacggagcaggcgatcacaaaccagtggttagcctgtcgtaatgcgcaagtctgtggcggaaccgactactttgggtgtccgtgtttccttttatttcatttatggctgcttatggtgacaatcgtagattgttatcataaagcgaattggattggccatccggtgaaattcaaatatactgtttatttatttgttggcttcgcgcctttaaattaccgcaccttagaactcattcacattatcttgctggttagacagtggtaccatc

SEQ ID NO: 1094 - DNA, 745 bp, Unknown
  Description of Unknown: Human coxsackievirus A24,strain USA-Tx79-10625 polyprotein gene,1 sequence
ttaaaacagctctggggttgttcccaccccagaggcccacgtggcggctagtacaccggtatcacggtacccttgtacgcctgttttatacccccttcccccgtaacttagaagctacacaccaagttcaatagaagggggtacaaaccagtaccaccgcgaacaagcacttctgtttccccggtgaagttgcatagactgtgcccacggttgaaagcgaccgatccgttacccgccttggtacttcgagaaacccagtaccactttggaatcaatgatgcgttgcgctcagcgctcgaacccggagcgtagcttaggctgatgagtctggacattccccactggtgacagtggtccaggctgcgttggcggcctacctgtggtgaaagccacaggacgctagttgtgaacaaggtgcgaagagtctattgagctaccatggagtcctccggcccctgaatgcggctaatcccaaccacggagcaggcactcacaagccagtgagacgcttgtcgtaatgcgaaagtctgtggcggaaccgactactttgggtgtccgtgtttccttttattctttgtatggctgcttatggtgacaatcgaagattgttatcataaagcaagttggattggccatccggtgagaattaaaagcattatttacttgcttattggattcactccaatcacatcatttactccacatctaatcaatcttgtgttgatactcagaaggtgttatcaaa

SEQ ID NO: 1095 - DNA, 745 bp, Unknown
  Description of Unknown: Human coxsackievirus A24,strain DOR93-10630 polyprotein gene,1 sequence
ttaaaacagctctggggttgttcccaccccagaggcccacgtggcggccagtacactggtattacggtacccttgtacgcctgttttacaccccttcccccgtaacttagaagctttaaacccaagttcaatagtaggtggtacaacccagtaccaccacgaacaagcacttctgttatcccggtgagattgcataagctgtccccacggctaaaagcgattgatccgttacccgctcttgtacttcgagaagcctagtaaaaccttggaatcttcgacgcgttgcgttcgacactcaaccccagagtgtagcttaggctgatgagtctggacattcctcaccggcgacggtggtccaggctgcgttggcggcctacctgtggcctaaagccacaggacgctagttgtgaacaaggtgtgaagagcctattgagctacaagggagtcctccggcccctgaatgcggctaatcccaaccacggagcaggtggttgcaatccagcaactggcctgtcgtaacgcgcaagtctgtggcggaaccgactactttgggtgtccgtgtttccttttattttttaatggctgcttatggtgacaatcacagattgttgtcataaagcgaattggattggccatccagtgagagttaagataattatctacttgtttattggatttgttcctataaccgcccatacaccttgcttgattgaagtgatcctgtcaataagacatcactattaca

SEQ ID NO: 1096 - DNA, 745 bp, Unknown
  Description of Unknown: Human coxsackievirus A24,strain Joseph, complete genome.1 sequence
ttaaaacagctctggggttgttcccaccccagaggcccacgtggcggccagtactccggtattgcggtacccttgtacgcctgttttacactcccttccccggtaacttagaagtaaacaaaccaagttcaatagaagggggtacaaaccagtaccaccacgaacaagcacttctgtttccccggtgacgttgtatagactgtacccacggttgaaaacaactgatccgttatccgctcttgtacttcgagaagcccagtatcaccttggaatcttcgatgcgttgcgctcagcactcaaccccagagtgtagcttaggtcgatgagtctggacaatcctcaccggcgacggtggtccaggctgcgttggcggcctacctgtggcccaaagccacaggacgctagttgtgaacaaggtgtgaagagcctattgagctacgagagagtcctccggcccctgaatgcggctaatcccaaccacggagcaggtgatcacaagccagtgattagcctgtcgtaacgcgcaagtctgtggcggaaccgactactttgggtgtccgtgtttcctttattttattatggctgcttatggtgacaatcacagattgttatcataaagcgacttggattggccatccagtgaaaataaaacacatcatttacctgattgttggatttactccgctgactatctactcaccaggtcttattaaggttattctgttgattaggtcacaatttcaca

SEQ ID NO: 1097 - DNA, 745 bp, Unknown
  Description of Unknown: Human coxsackievirus A13,strain Flores, complete genome.1 sequence
ttaaaacagctctcgggttgttccccccccagaggcccacgtggcggccagtactccggtattacggtacccttgtacgcctgttttgtatccccttcccccgcaacttagaagttataaaccaagttcaatagaagggggtacaagccagtaccaccacgaacaagcacttctgtttccccggtgatgttgtatagactgctaacgcggttgaaaacagctgatccgttatccgcttgtgtacttcgagaagcctagtatcatcttggaatcttcgatgcgttgcgttcagcgctctaccccagagcgtagcttaggctgatgagtctgggcattccccaccggcgacggtggcccaggctgcgttggcggcctacctatggctaacgccataggacgctagttgtgaacaaggtgtgaagagcctattgagctacacaagagtcctccggcccctgaatgcggctaatcctaaccatggagcaagtgatcacaatccagtgatattcttgtcgtaacgcgcaagtccgtggcggaaccgactactttgggtgtccgtgtttccttttacttttatcatggctgcttatggtgacaatcattgattgttatcataaagcgaattggattggccatccggtgaaagtgagacttatcatctacttgtttgttggattcactccattgaacacattcactcccagtatcatttcaatagtaatcagaattagacagttgtatcaca

SEQ ID NO: 1098 - DNA, 745 bp, Human enterovirus sp.
  99,strain USA-Ok85-10627 polyprotein gene,1
ttaaaacagctctggggttgttcccaccccagaggcccacgtggcggctagtactccggtattacggtacccttgtacgcctgttttaaatccccttccccgtaacttagaagcttaaaccaataagttcaatagaagggggtacaaaccagtaccaccacgaacaagcacttctgtttccccggtgcggtggtatagactgtacccacggttaaaaaccaccaatccgttatccgctctggtacttcgagaagcctagtaccaccttggaatctttgacgcgttgcgctcaacactcaaccccagagtgtagcttaggctgatgagtctgggcagtccccaccggtgacggtggcccaggctgcgttggcggcctacccatggctaatgccatgggacgctagaagtgaacaaggtgtgaagagcctattgagctactagagagtcctccggcccctgaatgcggctaatcccaaccacggatcaagtgcgcgcaacccagtgcgtagcttgtcgtaatgcgcaagtctgtggcggaaccgactactttgggtgtccgtgtttccttttattcttattatggctgcttatggtgacaatcttagattgttatcatatagcaattggattggccatccagtgagagtgagagatatcatatacctatttgtagcttttactccacttagcacgaacacagttactttgattagaattgtgctattgatcagattgacacatcact

SEQ ID NO: 1099 - DNA, 745 bp, Human enterovirus sp.
  99, complete genome.1
ttaaaacagctctggggttgttcccaccccagaggcccacgtggcggctagtactctggtatcacggtacctttgtacgcctgttttatatcccttcccccgtaacttagaagctttgtaccaacaagttcaatagaaggggtacaaaccagtaccaccacgaacaagcacttctgtttccccggtgcgatgacatagactgtacccacggtcaaaagtcaccaatccgttacccgctttggtacttcgagacgcctagtattgccttggaattctcgatgcgttgcgctcaacactcgaccctggagtgtagcttaggctgatgagtctgggcattccccaccggtgacggtggcccaggctgcgttggcggcctacccatagctattgctatgggatgctagagttgaacaaggtgtgaagagccaattgagctactaaagagtcctccggcccctgaatgcggctaatcccaaccacggatcaagtgcgtgcaacccagcacgtagcttgtcgtaatgcgcaagtctgtggcggaaccgactactttgggtgtccgtgtttccttttatttttatcatggctgcttatggtgacaatcttggattgttatcatatagcgattggattggccatccggtgagaataaaagatattgtttatctgtttgtggcttttactccattaaacaaaaacacactttccttaattaaagtggtactattgatcagatcagcataccaca

SEQ ID NO: 1100 - DNA, 745 bp, Human poliovirus 1
  isolate PV1-RC2010-45, complete genome.1
ttaaaacagctctggggttgttcccaccccagaggcccacgtggcggctagcactctggtattgcggtacctttgtgcgcctgttttatatccccgcccctacgtaactttagaagcaatacacagtgttcattaggaggggcacaaaccagtgtccttaagaacaagcacttctgtttccccggtgacctcgtataggctgtacccacggctaaaaacgagcgattcgttacccgcttaggtacttcgagaagcctagtaccgccttggaatcttcgacgcgttgcgctcagcactctaccccgagtgtagcttaggctgatgagtctgggcattccccaccggtgacggtggcccaggctgcgttggcggcctacccatggcctgcgccatgggacgctagttgtgaacaaggtgtgaagagcctattgagctacctaagaatcctccggcccctgaatgcggctaatcctaaccacggagcaagcaccctcaatccagggggtggcttgtcgtaacgcgcaagtctgtggcggaaccgactactttgggtgtccgtgtttccctttatttttattgtggctgcttatggtgacaatctttgattgccatcataaagcgaattggattggccatccggtgaaagttgaacacaccattcatctatttgttggattcacctcgttgactcagtttacacccaatttggtacatatagtgatagtgattagagaaaaataccaca

SEQ ID NO: 1101 - DNA, 745 bp, Coxsackievirus
  A20 genomic RNA, complete genome,strain: CAM1976.1
ttaaaacagctctggggttgttcccaccccagaggcccacgtggcggctagtactctggtattacggtacctttgtacgcctgttttatatcccctccccccagtaacttagaaacaaaaaacccaagttcaataggagggggtacaaaccagtaccaccacgaacaagcacttctgttttccccggtgaggttgtatagactgtccccacggtcgaaaatgactgatccgttacccgctcctgtacttcgagaagcccagtaacatcttggaatcttcgatgcgttgcgctcagcactcaaccccagagtgtagcttaggtcgatgagtctggacgctccccaccggcgacggtggtccaggctgcgttggcggcctacctgtggtccaaagccacaggacgttagttgtgaacaaggtgtgaagagcctattgagctacaagagagtcctccggcccctgaatgcggctaatcccaaccatggagcagatgattgcaaaccagcaattggtctgtcgtaatgcgtaagtctgtggcggaaccgactactttgggtgtccgtgtttcctttttactctttaatggctgcttatggtgacaatcacggattgttatcataaagcgaattggattggccatccggtgagaatcagaacgattatttcttcctcgtggatttgtaccaataacaccttacacaccgcacttaatcagagttatattgtgtgagatttcattaccata

SEQ ID NO: 1102 - DNA, 745 bp, Human poliovirus 1
  isolate RUS39223, complete genome.1
ttaaaacagctctggggttgttcccaccccagaggcccacgtggcggctagcactctggtatcacggtacctttgtgcgcctgttttatgtccccgcccccatgtaactttagaagcaatacacggtgttcattaggaggggcacaagccagtgttcctatgaacaagcacttctgtttccccggtgacctcgtataggctgtgcccacggctaaaaacgtgcgatccgttacccgcttgggtacttcgagaagcccagtaccaccttggaatcttcgacgcgttgcgctcagcactctaccccgagtgtagcttaggctgatgagtctgggcattccccactggtgacagtggcccaggctgcgttggcggcctacccattgctcgcgcaatgggacgctagatgtgaacaaggtgtgaagagcctattgagctgcctaagagtcctccggcccctgaatgcggctaatcctaaccacggagcaagcgccttcaacccagggggtggcttgtcgtaacgcgcaagtctgtggcggaaccgactactttgggtgtccgtgtttccctttgtttttattatggctgcttatggtgacaatcattgattgccatcataaagcgaattggattggccatccggtggaagttacatacatcatccatctatttgttggatttgcttcactaacacagttcacaatcaacttggtatatataataatagtgattagagaaaaataccata

SEQ ID NO: 1103 - DNA, 745 bp, Unknown
  Description of Unknown: Human coxsackievirus A20, strain BAN00-10462 polyprotein gene,1 sequence
ttaaaacagctctggggttgttcccaccccagaggcccacgtggcggctagtactctggtatctcggtacctttgtacgcctgttttatacccccttccccatgtaactttagaagcaattcaacaagttcaatagagggggtacaaaccagtaccaccacgaacaagcacttctgtttccccggtgattttacataagctgtgcccacggctgaaagtgaatgatccgttacccgcttgagtacttcgagaagcctagtatcgccttggaatcttcgatgcgttgcgctcagcactctaccccgagtgtagcttaggctgatgagtctgggcattccccaccggtgacggtggcccaggctgcgttggcggcctacccatggctaacgccatgggacgctagttgtgaacaaggtgtgaagagcctattgagctacttaagagtcctccggcccctgaatgcggctaatcccaaccacggagcaggcgccaccaatccaggaggtagcctgtcgtaacgcgtaagtctgtggcggaaccgactactttgggtgtccgtgtttccttttatctctttaatggctgcttatggtgacaatcatagattgttatcataaagcgaattggattggccatccggtgaagtgtaaacacattatttatttgttcattggatttactccattcacccgatttactccaaatataatacatattgtattgttgataagacgttgctactaca

SEQ ID NO: 1104 - DNA, 745 bp, Human poliovirus
  2, isolate Env2008_E3218 polyprotein gene, complete1
ttaaaacagctctggggttgttcccaccccagaggcccacgtggcggctagcactccggtattacggtacccttgtgcgcctgttttatactcccttcccccgcaatttagaagcatgaaacccggttcaatagtaaggggtacaaaccagtaccactatgaacaagcacttctgtctccccggtgatattgtatagactgctcacgcggttgaaagcgattgatccgttatccgcttgtgtacttcgagaagcctagtaccaccttcggaacttcgacgcgttgcgctcagcacccgaccccggggtgtagcttgggctgatgagtctggacgatcctcaccggcgacggtggtccaggctgcgttggcggcctacccgtggttcacaccacgggacgctacaagtgaacaaggtgtgaagagcctattgagctacacaagagtcctccggcccctgaatgcggctaatcccaaccacggagcaggcggtcacgaaccagtggctagcttgtcgtaacgcgcaagtctgtggcggaaccgactactttgggtgtccgtgtttcctgttatttttatcatggctgcttatggtgacaatcattgattgttatcataaagcgaattggattggccgtccggaaagtgttttatcacatatactgtttggtgaagctactacattaattctgcctctcactcggttagtcaaacagaactcagacagagtaaaacatcaccaacgca

SEQ ID NO: 1105 - DNA, 745 bp, Unknown
  Description of Unknown: Human coxsackievirus A21, strain GUT88-10619 polyprotein gene,1 sequence
ttaaaacagcctgtgggttgttcccaccccagaggcccacgcggcggctagtactctggtgctgcggtacctttgtacgcctgttttatacccccgtccccgcaatttagaagcaagaaaacaaagttcaatagtaggtggtgcaatccagcatcgctatgaacaagcacttttgttgccccggtgaggttgcatagactgttcccacggtcaaaagtgaccaatccgttacccgcttttgtacttcgagaagcctagtatcaccttggaatcttcgacgcgttgcgttccgcactcaaccccagggtgtagcttaggtcgatgagtctgggcggaccccaccggcgacggtggcccaggctgcgttggcggcctacctgtggtccaaagccacaggacgctagttgtgaacaaggtgtgaagagcctattgagctacaaaagagtcctccggcccctgaatgcggctaatcctaaccacggagcaggtggtcgcaaaccagtgattaacctgtcgtaatgcgcaagtctgtggcggaaccgactactttgggtgtccgtgtttctctttattttactatggctgcttatggtgacaatcgaggattgttatcataaagcgaattggattggccatccggtgaaagtgaaatacattatctattcaattgttgaattcatccagaacacacccgcaacactacatctgattaaactcgttttgataaccagagaacattaccaca

SEQ ID NO: 1106 - DNA, 745 bp, Unknown
  Description of Unknown: Human coxsackievirus A20, strain CVA20a-Tulane polyprotein gene,1 sequence
ttaaaacagcctgtgggttgttcccaccccagaggcccacgtggcggctagcactccggtattacggtacccttgtgcgcctgtttttatactcccttccccgtaacttagaagcacaaaaccaagttcaatagaagggggtacaaaccagtaccaccacgaacaagcacttctgtttccccggtgacgttgtatagactgctcacgcggttgaaagcgacgaatccgttatccgcttgtgtacttcgagaagcctagtaccaccttggaatcttcgacgcgttgcgctcggcactctaccccagagtgtagcttaggctgatgagtctgggcattcctcatcggcgacgatggcccaggctgcgttggcggcctacctatggctaacgccataggacgctagttgtgaacaaggtgtgaagagcctattgagctacacaagagtcctccggcccctgaatgcggctaatcctaaccatggagcaggagatcacaaaccagtggtattcctgtcgtaatgcgcaagtccgtggcggaaccgactactttgggtgtccgtgtttccttttatttttatcatggctgcttatggtgacaatcattgattgttatcataaagcgaattggattggccatccggtgaaaataagatttattatttacttgtttgttggattcactccgctaaacacattcactccaggtatcatctctatagtgattgaaattaggcaattacatcaca

SEQ ID NO: 1107 - DNA, 745 bp, Human enterovirus sp.
  102, complete genome.1
ttaaaacagctctggggttgttcccaccccagaggcccacgtggcggctagtactctggtatcacggtacctttgtacgcctgttttacatcccctcccccacgtaactttagaagcaattcaacaagttcaatagagggggtacaaaccagtatcaccacgaacaagcacttctgtttccccggtgattttacataagctgtgcccacggctgaaagtgaatgatccgttacccgctcgagtacttcgaaaagcctagtatcgctttgggatcttcgacgcgttgcgctcagcactctaccccgagtgtagcttaggctgatgagtctgggcattccccatcggcgacgatggcccaggctgcgttggcggcctacccatggctaacgccatgggacgctagttgtgaacaaggtgtgaagagcctattgagctactcgagagtcctccggcccctgaatgcggctaatcccaaccacggatcaggtgcctccaacccaggaggtggcctgtcgtaacgcgcaagtctgtggcggaaccgactactttgggtgtccgtgtttccttttatcttttaaatggctgcttatggtgacaatcatagattgttatcataaagcgaattggattggccatccggtgaaatacaaacacattatttacttgtttgttggatttactccgctcacacagcttactcctaagataatatttattgtattgctggtaaggagacactattata

SEQ ID NO: 1108 - DNA, 745 bp, Human echovirus
  11,strain D207, complete genome.1
tttaaaacagcctgtgggttgttcccacccacagggcccactgggcgccagcactctggtattgcggtaccttagtgcgcctgttttatatacccatcccccaaacgtgatttagatgcatgttaacgaagaccaatagtaagcgcagcacaccagctgtgttccggtcaagcacttctgttaccccggactgagtatcaataagctactcacgtggctgaaggagaaaacgttcgttacccggccaattacttcgagaaacccagtaacaccatgaaggttgcgcagtgtttcgctccgcacaaccccagtgtagatcaggtcgatgagtcaccgcattccccacgggtgaccgtggcggtggctgcactggcggcctgcccatggggtaacccatgggacgcttcaatactgacatggtgcgaagagtctattgagctaattggtagtcctccggcccctgaatgcggctaatcctaactgcggagcagatacccacacgccagtgggcagtctgtcgtaacgggcaactctgcagcggaaccgactactttgggtgtccgtgtttctctttatccttatactggctgcttatggtgacaattgggagattgttaccatatagctattggattggccatccagtgacaaatagagcaatcgtgtatttgtttgttggtttcgtaccattaaattacaaggtcataaacaccctcaatcttattatagcattcaatacaacaaa

SEQ ID NO: 1109 - DNA, 745 bp, Human enterovirus sp.
  79,strain USA/CA79-10384, complete genome.1
ttaaaacagcctgtgggttgtacccacccacagggcccactgggcgctagcacactggtatcccggtacctttgtgcgcctgttttataccccctcccccatatcgtaacatagaagcaatgcactcccggtcaatagctgacgtgacaaaccagttgcgttttgaccaagcacttctgtaaccccggaccgagtatcaataagctgcttgcgcggctaaaggagaaaccgtccgttacccggctaactacttcgagaaacctagtaccaccatgaacgttgcggagtgtttcgctcagcacttcccccgtgtagatcaggtcgatgagccaccgcattccccacgggcgaccgtggcggtggctgcgttggcggcctgcctgtggggcaacccacaggacgctctaatatagacatggtgtgaagagtctattgagctagttagtagtcctccggcccctgaatgcggctaatcctaactgcggagcacatacccctaatccaaggggcagtgtgtcgtaacgggcgactctgcagcggaaccgactactttgggtgtccgtgtttccttttatcttttatattggctgcttatggtgacaattgcagagttgttaccatatagcttttggattggccatccggtgagcaatagagctgttatttatcaatttgttggattcgtcgcactcaaccacacagtctttagaacactcggatttatcttgacccttaatacgagaaa

SEQ ID NO: 1110 - DNA, 745 bp, Echovirus
  E30,strain 13-311, complete genome.1
ttaaaacaagcctgtgggttgaacccactcacagggcccaatgggcgctagcacactggtatcacggtacctttgtgcgcctgttttatccaccctttccccgaacgaaacttagaagtttgaattaaacggtcaataggaaacccagtacaccaactgggctgtgaccaagcacttctgtgaccccggaccgagtatcaataagctactcacgtggctgaaggagaaaacgttcgttacccggccaattacttcgagaaacttagtaccaccatgaaagttgcgcagcgtttcgctccgcacgaccccagtgtagatcaggctgatgagtcaccgcgtaccccacgggtgaccgtggcggtggctgcgttggcggcctgcccttggggcaacccaagggacgcttcaatactgacatggtgcgaagagtctattgagctaattggtagtcctccggcccctgaatgcggctaatcccaactgcggagcagatacccacataccagtgggcagtctgtcgtaatgggcaactctgcagcggaaccgactactttgggtgtccgtgtttcctttatttcttacactggctgcttatggtgacaattgagagattgttgccatatagctattggattggccatccggtgtctaatagagcaattatctacctttttgttggatttattccacttaactataaagcactcaaaacacttatatacattgtagatctcaacacagcaaa

SEQ ID NO: 1111 - DNA, 745 bp, Enterovirus sp.
  B73,isolate 088/SD/CHN/04, complete genome.1
tttaaaacagcctgtgggttgttcccacccacagggcccactgggcgctagcacactggtatcacggtacctttgtgcgcctgttttatacacccccccctacatcgtaatttagaagtccaagccaaacggtcaatagacaacccagtatgccaactgggtcccgaccaagcacttctgttgccccggaccgagtatcaataagctgcttgcgcggctgaaggagaaagcgttcgttacccggccaattacttcgagaaacccagtaacaccatggaagttgcgtggcgtttcgctccgcacaaccccagtgtagatcaggtcgatgagtcaccgcaaccctcacgggcgaccgtggcggtggctgcgttggcggcctgcccatgggacaacccatgggacgcttcaataccgacatggtgcgaagagtctattgagctaattggtattcctccggcccctgaatgcggctaatcctaactgcggagcagacacccacatgccagtgggcagtctgtcgtaacgggaaactctgcagcggaaccgactactttgggtgaccgtgtttcctattatccttattctggctgcttatggtgacaattgaaagattgttaccatatagctattggattggccatccggtgtctaatagagctattatatacctctttgttggatttataccacttaacaaagtaaactaccagactctgtgctatatcattggattgaacacggtgaa

SEQ ID NO: 1112 - DNA, 745 bp, Unknown
  Description of Unknown: Human coxsackievirus B5, isolate 20CSF, complete genome.1 sequence
ttttaaaacaggctgtgggttgttcccacccacagggcccattgggcgccagcacactggtattacggtacctttgtgcgcctgttttatccaccccctccccaatgtaacgtagaagcacaaaccaagtggtcaatagatggctcagtacaccaactgggcttagaccaagcacttctgttaccccggactgagtatcaataggctgctcacgcggctgaaggagaaaacgttcgttacccgaccaactacttcgagaagcctagtaccatcatgaaggatgcgcagtgtttcgttcagcacaaccccagtgtagatcaggccgatgagtcaccgcaatccccacgggtgaccgtggcggtggctgcgctggcggcctgcccatggggcaacctatgggacgcttcaatttcgacatggtgcgaagagcctattgagctagttggtagtcctccggcccctgaatgcggctaatcccaactgcggagcagacacccacaaaccagtgggcagtttgtcgtaacgggcaactctgcagcggaaccgactactttgggtgtccgtgtttccttttatctatatattggctgcttatggtgacaattgagggattgttgccatatagctattggattggccatccggtaacaaacagagctattatttacctttttgttggcttcgtgccgttgaactttaaagttattaaaaccatatacttcatcttgacactcaacacagcaaa

SEQ ID NO: 1113 - DNA, 745 bp, Unknown
  Description of Unknown: Human coxsackievirus B3, strain A103/KM/09, complete genome.1 sequence
aaaacaagcctgtgggttgctcccggccccacaggggcccactgggcgctagcacactggtattgcggtacccttgtgcgcctgttttatccaccctccccaaccgtaatttagaagcacgaacaacgtggtcaacaggcaacccagtataccaactgggtctcgaccaagcacttctgtcaccccggactgagtatcaataagctgctcgcgtggctgaaggagaaaacgttcgttacccggccaattacttcgagaaacctagtatcaccatggaagttgcgcagtgtttcgctccgcacaaccccagtgtagatcaggtcgatgagtcaccgcaaccctcacgggtgaccgtggcggtggctgcgctggcggcctgcccatggggcaacccatgggacgcttcaatactgacatggtgcgaagagtctattgagctaattggtaatcctccggcccctgaatgcggctaatcctaactgcggagcagatatccacacaccagtggacagtctgtcgtaatgggcaactctgcagcggaaccgactactttgggtgtccgtgtttccttttattctttttattggctgcttatggtgacaattgagagattgttaccatatagctattggattggccatccggtgagcaacaggtcaattgtattcctctttgttggatttgtgccattaaactataataactacaacaccctgctttacattatccatttaaacacacagaa

SEQ ID NO: 1114 - DNA, 745 bp, Coxsackievirus
  A24 clone V19C polyprotein gene, partial cds.1
gctctggggttgttcccaccccagaggcccacgtggcggctagtactcccggtatcacggtacccttgtacgcctgttttatactccctttcccccgcaacttagaagattatgagaatccacgttcaacaggaagggggtacaaaccagtaccaccacgaacaagcacttctgtttccccggtgaggttgtatagactgtacccacggttgaagacgactgatccgttacccgctctagtacttcgagaagcttagtaacaccttggaatcatcgatgcgttgcgttcaacactcaaccccagagtgtagcttaggctgatgagtctggacaatcctcaccggtgacggtggtccaggctgcgctggcggcctacctgtggtccaaaaccacaggacgctagatgtgaacaaggtgcgaagagcctattgagctactagagagtcctccggcccctgaatgcggctaatcccaaccacgaagcaagtgctcacgatccagtgagtggcttgtcgtaacgcgtaagttcgtggcggaaccgactactttgggtgtccgtgtttcctttttaactttatatggctgcttatggtgacaatcattgattgttatcataaagcgatttggattggccatccagtgagagcgagaacaactacttatttgctcgttggatttgctccttcgacaagctacattttagatatcattctcattgtattcttgatcagaaagcaatatcata

SEQ ID NO: 1115 - DNA, 745 bp, Human enterovirus sp.
  B, isolate LR11F7 polyprotein gene, partial cds.1
ttaaaacagcttgggggtgtttcccacccacagggcccactgggcggtagcactctggtattacggtacctttgtgcgccttttttatatccccacccccgattgtaacttagaagaaataattcacgaccaatagtaggcgtggcgcgccagccatgttttggtcaagtacttctgtttccccggatcgagtatcaataggctgtccacacggctgaaggagaaagcgtccgttatccggccaattacttcgagaaacctagtaccaccatgaaagttgcgcagtgtttcgctccgcacaaccccagtgtagatcaggtcgatgagtcaccgcttccctcacgggcgaccgtggcggtggctgcgctggcggcctgcccatggggaaacctatgggacgctccaatactgacatggtgcgaagagtctattgagctaattggtagtcctccggcccctgaatgcggctaatcccaactgcggagcagatacccacatgccagtgggcagtctgtcgtaacgggcaactctgcagcggaaccgactactttgggtgaccgtgtttccttttattcctatactggctgctaatggtgacaattgaaagattgttaccatatagctattggattggccatccggtaactaacagagcgattgtttaccaatttgttggttttgtaccactagactacaaggtcttaaacaccttaaactatatcttgacactcaacacattgaaaag

SEQ ID NO: 1116 - DNA, 746 bp, Coxsackievirus
  A10, strain 09-1996-1, complete genome.1
gtgctcttccgatctgtgggttgcacccacccacagggcccactgggcgttagcactctggtaccatggtacccttgtgcgcctgttttatcaccctaacccaacttgaaacttagaagcaatacacaatcgaccaatagtaggtgtggcgcaccagccgcatcttggtcaagcacttctgtttccccgggttgagtatcaataagctgtccacacggctgaaggagaaaacgcccgttatccggccaactacttcgagaaacctagtaccactatgaacgttgcaaggcgtttcgctcagcacttcccccgtgtagatcaggtcgatgagtcaccgcattccccacgggcgaccgtggcggtggctgcgttggcggcctgcctatgggttaacccataggacgccttaatactgacatggtgcgaagagtctattgagctagttggtagtcctccggcccctgaatgcggctaatcctaactgcggagcacatactcacaacccagtgagcggtgtgtcgtaatgggtaaccctgcagcggaaccgactactttgggtgtccgtgtttccttttattcttacattggctgcttatggtgacaatcatagaattgttaccatatagctattggattggccatccgatttctaacagagctattatttacctgtttgttggatttactccgttgacatacaaatccctaaacactttgtgctttatcttgaacttgaacgcacgaaa

SEQ ID NO: 1117 - DNA, 746 bp, Coxsackievirus
  A10, strain 16-2871-1, complete genome.1
tgctcttccgatctgtgggttgtacccacccacagggcccattgggcgctagcactctggtaccatggtacccttgtgcgcctgttttatcaccccgcccctacctgaaacgtagaagctataatcaatcggccaatagtgggtgtggcataccagccacatcttggtcaagcacttctgtttccccgggttgagtatcaatatgctgttcacacggctgaaggagaaaacacccgttacccggccaactacttcgagaagcttagtaccgccatgaacattgcaaggcgtttcgctcagcactttccccgtgtagatcaggccgatgagtcaccgcattccccacgggcgaccgtggcggtggctgcgttggcggcctgcctgtgggttaacccacaggacgccttaatatagacatggtgcgaagagcctattgagctagttggtattcctccggcccctgaatgcggctaatcctaactgtggagcacatactcacaagccagtgggtggtgtgtcgtaacgggcaactctgcagcggaaccgactactttgggtgtccgtgtttcctttttatccttatattggctgcttatggtgacaatcagagaattgttaccatatagctattggattggccatccggtgtgcaacagagctattgtgtatttgtttgttggatttgtcccactatcgtatacacccctcaacaccttgtattttattttgagattgaacgcaagaaa

SEQ ID NO: 1118 - DNA, 746 bp, Coxsackievirus
  A4, isolate CV-A4/P1033/2013/China, complete genome.1
tttaaaacagcctgtgggttgtacccacttgcagggcccactgggcgctagcactctgattctgcgggatctttgtgcgcctgttttataaccccacccctactcgtaacttagaagtaacacacaccattgatcaacagcaagcgtggcgcaccagccacgtttagatcaagcacttctgtttccccggactgagtatcaatagactgctcacgcggttgaaggagaaatcgttcgttacccggctaactacttcgagaaacctagtagcaccattgaaactgcagagtgtttcgttcagcactttccccgtgtagatcaggccgatgagtcactgcaatccccacgggcgaccgtggcagtggctgcgttggcggcctgcctatgggctttcccataggacgctctaatgtggacatggtgtgaagagtctattgagctagttagtagtcctccggcccctgaatgcggctaatcctaactgcggagcgcataccctcaatccagggggtggtgcgtcgtaacgggcaactttgcagcggaaccgactactttgggtgtccgtgtttccttttattcttatattggctgcttatggtgacaattgagaaattgttaccatatagctattggattggccatccagtgtctaacagagcagttgtatacttatttgctggattcgttccactatcatacacatctattaataccttatattatattataagattgaacgcaaggaa

SEQ ID NO: 1119 - DNA, 746 bp, Coxsackievirus
  A4, isolate CV-A4/2016/HFMD/305, complete genome.1
tttaaaacagcctgtgggttgtacccacctacagggcccactgggcgctagcactctgattccacggaatccttgtgcgcctgttttatatcccctccccaagttgcaacttagaagcattgcactacaatgatcagtagcaggcgtggcgctccagccatgtctcgatcaagcacttctgtttccccggaccgagtatcaatagactgctaacgcggttgaaggagaaaacgttcgttatccggctaactacttcgagaaacctagtagcaccatcgaagctgcggggcgtttcgctcagcacttcccccgtgtagatcaggtcgatgagtcactgcaatcctcacgggcgaccgtggcagtggctgcgttggcggcctgcctatggggcaacccataggacgcttcaaagtggacatggtgtgaagagtctattgagctagttagtagtcctccggcccctgaatgcggctaatcctaactgcggagcacataccttcaatccaggaggtagtgtgtcgtaacgggcaactctgcagcggaaccgactactttgggtgtccgtgtttccttttattctcttattggctgcttatggtgacaattgaagaattgttaccatatagctattggattggccatccagtgtctaacagagcaattgtgtacttatttgttggttttgttcctttgtctcacacgtcccttagtactttgtattacattataaaactgaattcggagag

SEQ ID NO: 1120 - DNA, 746 bp, Enterovirus 7sp.
  1 polyprotein gene, complete cds.1
tttaaaacagcctgtgggttgcacccacccacagggcccactgggcgctagcactctggtactgaggtacctttgtgcgcctgtttttactccccttcccccgaagtaacttagaagctgtaaatcaacgatcaatagcaggtgtggcacaccagtcataccttgatcaagcacttctgtttccccggactgagtatcaataggctgctcgcgcggctgaaggagaaaacgttcgttacccgaccaactacttcgagaagcttagtaccaccatgaacgaggcagggtgtttcgctcagcacaaccccagtgtagatcaggctgatgagtcactgcaacccccatgggcgaccatggcagtggctgcgttggcggcctgcccatggagaaatccatgggacgctctaattctgacatggtgtgaagagcctattgagctagctggtagtcctccggcccctgaatgcggctaatcctaactgcggagcacatgctcacaaaccagtgggtggtgtgtcgtaacgggcaactctgcagcggaaccgactactttgggtgtccgtgtttccttttattcctatattggctgcttatggtgacaatcaaagagttgttaccatatagctattggattggccatccggtgtgcaacagggcaattgtttacctatttattggttttgtaccattatcactgaagtctgtgatcactctcaaattcattttgaccctcaacgcaatcaaac

SEQ ID NO: 1121 - DNA, 746 bp, Human enterovirus sp.
  71, isolate HN1360/HN/CHN/2011, complete genome.1
ttttaaaaaccagcctgtgggttgcacccactcacagggcctactgggcgcaagcactctggtacctcggtacctttgtgcgcctgttttacaccccccccctagtgaaacttagaagcagcaaaccacgatcaatagcaggcataacgctccagttatgtcttgatcaagcacttctgtttccccggactgagtatcaatagactgctcgcgcggttgaaggagaaaacgttcgttatccggctaactacttcggaaaacctagtaacaccatgaaagttgcggagagcttcgttcagcactcccccagtgtagatcaggtcgatgagtcaccgcattccccacgggcgaccgtggcggtggctgcgttggcggcctgcccatggggtaacccatggggcgctctaatacggacatggtgtgaagagtctactgagctagttagtagtcctccggcccctgaatgcggctaatcccaactgcggagcacacgcccacaagccagcgggtagtgtgtcgtaacgggtaactctgcagcggaaccgactactttgggtgtccgtgtttccttttatctttatattggctgcttatggtgacaattaaagaattgttaccatatagctattggattggccatccggtgtgtaatagagcaattatttacctatttattggttttgtaccattaaccttgaattctgtgaccacccttaattatattttgacccttaacacagctaaac

SEQ ID NO: 1122 - DNA, 746 bp, Human enterovirus sp.
  71, strain 3149 polyprotein gene, complete cds.1
ttaaaacagcctgtgggttgttcccacccacagggcccactgggcgctagcacactgattctacggaaactttgtgcgcctgttttatgtccctccccctaatatgtaacttagaaatttagtacacccatgaccaatagtaggcgtgacgcaccagtcacgtcttggtcaagcacttttgtttccccgggctgagtatcaatagactgcttacgcggttgaaggagaaaacgttcgttacccggctaactacttcgagaaacctagtaacaccatgaaagttgcagggtgtttcgctcagcacttcccccgtgtagatcaggtcgatgagtcactgcaaaccccacgggcgaccgtggcagtggctgcgttggcggcctgcccatggggtaacccatgggacgctctgatactgacatggtgcgaagagtctattgagctagttagtagtcctccggcccctgaatgcggctaatcctaactgcggagcacacaccctcaacccagggggcggtgtgtcgtaacgggcaactctgcagcggaaccgactactttgggtgtccgtgtttccttttatctctattatggctgcttatggtgacaattgaagaattgttaccatatagctattggattggccatccggtgtttaacagagcaattgtatacctatttgttggatttgtccctttgtcacacacatctctcaataccttatactacattataaagttgaatacaggaac

SEQ ID NO: 1123 - DNA, 746 bp, Enterovirus sp.
  A71, isolate NER-13-194, complete genome.1
ttaaaacagcccgtgggttgtacccactcacggggtccactggacgctagcactctggttccacggaacctttgtgcgcctgttttatacccctccccaacttgtaacgtagaagcagtacctaatatcgatcaatagtaggtgtggcgcaccagccatatcttgatcaagcacttctgtctccccggaccgagtatcaatagactgctcacgcggttgaaggagaaagcgttcgttacccggctaactacttcgagaaacctagtagcaccatggaagctgcggagtgtttcgctcagcacttcccccgtgtagatcaggtcgatgagtcactgcaatcctcacgggtgaccgtggcagtggctgcgttggcggcctgcctgtggggcaacccacaggacgctctaatgtggacatggtgcgaagagtctattgagctagttagtagtcctccggcccctgaatgcggctaatcctaactgcggagcgcatgccctcaatccagagggtagtgcgtcgtaacgggcaactctgcagcggaaccgactactttgggtgtccgtgtttccttttactcttatattggctgcttatggtgacaattacggaattgttaccatatagctattggattggccatccggtgtgcaatagagctatcatttacctatttgttggatttgtaccactgtcattaaagtccataaccacactcaattatatactcactctcaatataactaaac

SEQ ID NO: 1124 - DNA, 746 bp, Human enterovirus sp.
  71 polyprotein gene, complete cds.1
ttaaaacagctgtgggttgttcccactcacagggcccactgggcgctagcactctgattttacgaaatccttgtgcgcctgttttatatcccttccctaattcgaaacgtagaagcaatgcgcaccactgatcaatagtaggcgtaacgcgccagttacgtcatgatcaagcatatctgttcccccggactgagtatcaatagactgcttacgcggttgaaggagaaaacgttcgttatccggctaactacttcgagaagcccagtaacaccatggaagctgcagggtgtttcgctcagcacttcccccgtgtagatcaggtcgatgagccactgcaatccccacaggtgattgtggcagtggctgcgttggcggcctgcctatggggagacccataggacgctctaatgtggacatggtgcgaagagcctattgagctagttagtagtcctccggcccctgaatgcggctaatcctaactgcggagcacatgccttcaacccagagggtagtgtgtcgtaatgggcaactctgcagcggaaccgactactttgggtgtccgtgtttctttttattcttatattggctgcttatggtgacaattacagaattgttaccatatagctattggattggccatccggtgtgtaatagagctgttatatacctatttgttggctttgtaccactaactttaaaatctataactaccctcaactttatattaaccctcaatacagttgaac

SEQ ID NO: 1125 - DNA, 746 bp, Coxsackievirus
  A16 gene for polyprotein,isolate1
ttaaaacagcctgtgggttgttcccacccacagggcccattgggcgctagcacactgactttgcggagtctttgtgcgcctgttttataacccttcccccaagtagcaacttagaagtattgcacaaccgcggccagtagtgggcgtgacgcgccagtcacgtcttggtcaagcacttctgtatccccggactgagtatcaatagactgctcgcgcggttgaaggagaaaacgttcgttatccggctaactacttcgggaaacctagtagcaccttggaagttgcagagtgtttcgctcagcactttccccgtgtagatcaggtcgatgagccactgtaaaccccacgggcgaccgtgacagtggctgcgttggcggcctgcccatggggtaacccatgggacgctctaatacagacatggtgtgaagagtctactgagctagttagtagtcctccggcccctgaatgcggctaatcctaactgcggagcacacaccctcaatccagggggcggtgtgtcgtaatgggtaactctgcagcggaaccgactactttgggtgtccgtgtttccttttattcctttactggctgcttatggtgacaattgaaaagttgttaccatatagctattggattggccatccggtgtctaacagagctattgtctacttgtttattggatacgtccctcttaatctcaaggtcattcgaactcttgattatatattgctccttaattataggaa

SEQ ID NO: 1126 - DNA, 746 bp, Coxsackievirus
  A7 gene for polyprotein, polyprotein region,strain1
tttaaaacagcctgtgggttgcacccacccacagggcccactgggcgccagcactctgattccgcggaatctttgtgtgcctgttttatcacccttcccccaaacttgcaacttagaagcagcacttcactgaccaatagcaggcgtggcgcaccagccatgtctaggtcaagcacttctgtttccccggactgagtatcaataggctgctcacgcggctgaaggagaaaacgttcgtcatccggctaactacttcgagaaacctagtagcaccggtgaagctgcagagtgtttcgctcagcacttcccccgtgtagatcaggtcgatgagtcactgcactccccacgggcgaccgtggcagtggctgcgctggcggcctgcctatgggtcaacccataggacgctctaatgtggacacggtgcgaagagtctattgagctagttagtagtcctccggcccctgaatgcggctaatcctaactgcggagcacatgcccccgaaccagggggtggtgtgtcgtaacgggcaactctgcagcggaaccgactactttgggtgaccgtgtttccttttgttcttattatggctgcttatggtgacaattgaagaattgttaccatatagctattggattggccatccagtgtctaacagagctatcatatacctatttgttggattcgttctattgtcatacacatcactcaatacattacattttattgtgagattaaatacaagaaa

SEQ ID NO: 1127 - DNA, 746 bp, Coxsackievirus
  A7 gene for polyprotein, polyprotein region,strain1
tttaaaacagcctgtgggttgtacccacccatagggcccactgggcgccagcactctgattctgcggaatctttgtgcgcctgttttatcaccctctccctaaattcgtaacttagaagcaacactctactgaccaatagcgggcgtggcgcaccagccatgtctaggtcaagcacttctgtctccccggactgagtatcaataggctgctcacgcggctgaaggagaaaacgttcgtcatccggctaactacttcgagaagcctagtagcaccgttgaaactgcagagtgtttcgctcagcactttccccgtgtagatcaggtcgatgagtcactgcactccccacgggcgaccgtggcagtggctgcgttggcggcctgcctatgggtcaacccataggacgctctaatgtagacacggtgcgaagagtctatcgagctagttagtagtcctccggcccctgaatgcggctaatcctaactgcggagcacatgcccccgagccagagggtggtgtgtcgtaacgggtaactctgcagcggaaccgactactttgggtgtccgtgtttccttttattcttgatatggctgcttatggtgacaattgaagaattgttaccatatagctattggattggccatccggtgtctaacagagctattgtatacctgtttgttggatttgttccattatcacaaacatcactcaacacactacacttcattgtgagattgaacgcaagaaa

SEQ ID NO: 1128 - DNA, 746 bp, Coxsackievirus
  A2,isolate HeN13-6/HeN/CHN/2013, complete genome.1
ttaaaacagctctggggttgtacccacccgcagggcccactgggcgctagcacactgattctacggaacctttgtgcgcctgttttatatccctcccccgaaacagcaacttagaagttgaacatttacacgaccaatagtgggcatggcgcgccagccatgtcttggtcaagcactcctgtttccccggactgagtatcaataggctgctcacgtggctgaaggagaaagagttcgttacccggctaactacttcgagaaacttagtaacaccatgaatgttgcagagtgtttcgctcagcacttcccccgtgtagatcaggctgatgagccactgcaaaccccacgggcgaccgtggcagtggctgcgttggcggcctgcctatggggcaacccataggacgctctaatacagacatggtgcgaagagtctattgagctagttagtattcctccggcccctgaatgcggctaatcccaactgcggagcacatgccctcaatccagagggtggtgtgtcgtaacgggcaactctgcagcggaaccgactactttgggtgtccgtgtttccttttattcttatattggctgcttatggtgacaattgaaagattgttaccatatagctattggattggccacccggtgactaacagagctttaatttaccaattcactgggtttgtacctttatcacctacagtttatcagactttggtgtatctgttatatctcaacagtaagaa

SEQ ID NO: 1129 - DNA, 746 bp, Enterovirus C
  isolate Brunenders, complete genome.1
ttaaaacagctctggggttgttcccaccccagaggcccacgtggcggccagtacaccggtaccacggtacccttgtacgcctgttttatactcccctccccgtaaactagaagcacgaaacacaagttcaatagaagggggtacagaccagtaccaccacgaacaagcacttctgttcccccggtgaggtcacatagactgtccccacggtcaaaagtgactgatccgttatccgctcacgtacttcggaaagcctagtaccaccttggaatctacgatgcgttgcgctcagcactcgaccccggagtgtagcttaggctgatgagtctggacgttccccactggtgacagtggtccaggctgcgttggcggcctacctgtggtccaaaaccacaggacgctagtagtgaacaaggtgtgaagagcccactgagctacctgagaatcctccggcccctgaatgcggctaatcccaaccacggagcaggtaatcgcaaaccagcggtcagcctgtcgtaacgcgtaagtctgtggcggaaccgactactttgggtgtccgtgtttccttttatttttatggtggctgcttatggtgacaatcatagattgttatcataaagcaaattggattggccatccggagtgagctaaactatctatttctctgagtgttggattcgtttcacccacattctgaacaatcagcctcattagtgttaccctgttaataagacgatatcatcacg

SEQ ID NO: 1130 - DNA, 746 bp, Human enterovirus sp.
  96,strain BAN00-10488, complete genome.1
ttaaaacagctctggggttgttcccaccccagaggcccacgtggcggccagtactccggtatcacggtacccttgtacgcctgttttatacccccttccccgcaacttagaagctttaaattcaagttcaatagaaggtggtacaaaccagtatcgccacgaacaagcacttctgttgccccggtgaaattgcataagctgtccccacggctgaaggcgattgatccgttacccgctcttgtacttcgagaagcctagtaccaccttggaattttcgatgcgttgcgctcagcactcaaccccagagtgtagcttaggctgatgagtctggacataccccaccggcgacggtggtccaggctgcgttggcggcctacctgtggcccaaagccacaggacgctagttatgaacaaggtgtgaagagcctattgagctacaagagagtcctccggcccctgaatgcggctaatcctaaccacggatcaggcgattgcaacccagcaattagcctgtcgtaatgcgcaagtctgtggcggaaccgactactttgggtgtccgtgtttctttttattcttacattggctgcttatggtgacaatcttagattgttatcataaagcaagttggattggccatccggtgaaagtcaaagttactatctatttatctgttggattttaccctaagaccactcatttacctgacttaattagaataattatactacttggaaattactatcaca

SEQ ID NO: 1131 - DNA, 746 bp, Unknown
  Description of Unknown: Human coxsackievirus A11,isolate CV-A11_66990, complete genome.1 sequence
ttaaaacagctctggggttgttcccaccccagaggcccacgtggcggctagtacaccggtatcacggtacccttgtacgcctgttttatattcccttccccgtaacttagaagcaataaactcaagttcaatagaagggggtgcaaaccagcaccaccacgaacaagcacttctgtttccccggtgagattgcatagactgtccccacggttgaaagcgattgatccgttaaccgctcttgtacttcgagaagcctagtaccatcctggaatctacgatgcgttgcgctcagcactcaatcccagagtgtagcttaggtcgatgagtctggatactccccaccggcgacggtgatccaggctgcgttggcggcctacctgtggtccaaagccacaggacgctagtagtgaacagggtgtgaagagcctattgagctacatgagagtcctccggcccctgaatgcggctaatcccaaccacggagcaggtggctacaacccagtaactggcctgtcgtaacgcgcaagtctgtggcggaaccgactactttgggtgtccgtgtttccttttatttttataatggctgcttatggtgacaatcattgattgttatcataaagcgacttggattggccatccagcgagaatcagatcgattatttatttgtttgttggattcaccaccttatctacatacacaccaaacttaattagaatcactttattgattaggtatcattatcacg

SEQ ID NO: 1132 - DNA, 746 bp, Unknown
  Description of Unknown: Human coxsackievirus A11 strain Belgium-1, complete genome.1 sequence
ttaaaacagctgtggggttgttcccaccccagaggcccacgtggcggctagtactccggtatcacggtacccttgtacgcctgttttatactccctcccccgtaacttagaagcaatcaaatcaagttcaataggagggggtacaaaccagtaccaccacgaacgagcacttctgtttccccggtgaagttgcatagactgttaccacggttgaaagcgaccgatccgttatccgctcatgtacttcgagaagcctagtacctccttggaatcttcgatgcgttgcgctcagcactcaaccccggagtgtagcttaggctgatgagtctggacagccctcaccggcgacggtggtccaggctgcgttggcggcctacctgtggcccaaagccacaggacgctagttgtgaacaaggtgtgaagagcctattgagctacatgagagtcctccggcccctgaatgcggctaatcctaaccacggagcaggcgatcgcaaaccagcaattagcctgtcgtaacgcgaaagtctgtggcggaaccgactactttgggtgaccgtgtttctcttatttttattcatggctgcttatggtgacaatcatagattgttatcataaagcgagttggattggccatccggtaaaagtcaagtatatcatttacttgtttgtaggatttattcctttgaacgtccatttactcaatcttatcagagtcacattactagtaagatctcactatcaca

SEQ ID NO: 1133 - DNA, 746 bp, Human enterovirus sp.
  99,strain BAN01-10582 polyprotein gene, complete1
ttaaaacagcctgtgggttgttcccaccccagaggcccacgtggcggctagtactctggtatcacggtacctttgtacgcctgttttatatcccttcccccgtaacttagaagctttgtaccaacaagttcaatagaaggggtacaaaccagtaccaccacgaacaagcacttctgtttccccggtgcgatgacatagactgtacccacggtcaaaagtcaccaatccgttacccgctttggtacttcgagacgcctagtattgccttggaattctcgatgcgttgcgctcaacactcgaccctggagtgtagcttaggctgatgagtctgggcattccccaccggtgacggtggcccaggctgcgttggcggcctacccatagctattgctatgggatgctagagttgaacaaggtgtgaagagccaattgagctactaaagagtcctccggcccctgaatgcggctaatcccaaccacggatcaagtgcgtgcaacccagcacgtagcttgtcgtaatgcgcaagtctgtggcggaaccgactactttgggtgtccgtgtttccttttatttttatcgtggctgcttatggtgacaatcatagattgttatcataaagcgaattggattggccatccagtgagaatcaagtcgctgatatatttatttgttggatttaccaaaatcaaccacagaacaccagttttaattcgtattgtgttactaattagatttcactactaca

SEQ ID NO: 1134 - DNA, 746 bp, Human enterovirus sp.
  99,strain BAN04-10697 polyprotein gene, complete1
ttaaaacagcctgtgggttgttcccaccccagaggcccacgtggcggctagtactccggtattacggtacccttgtacgcctgttttatacccccttcccccgcaacttagattcaaacaaacacaagttcaataggagggggtacaaaccagtaccaccacgaacaagcacttctgtttccccggtgaggttgtatagactgttaccacggttgaaagcgactgatccgttatccgccttagtacttcgagaagcctagtatcaccttggaatctccgatgcgttgcgctcagcaatgtacccccattgtagcttaggccgatgagtctgggcattccccaccggcgacggtggcccaggctgcgttggcggcctacctatggtgaaaaccataggacgctagttgtgaacaaggtgcgaagagcctattgagctactaaggagtcctccggcccctgaatgcggctaatcccaaccacggagcaggtagttgcaaaccagcaaccagcctgtcgtaatgcgcaagtctgtggcggaaccgactactttgggtgtccgtgtttccttttattcttataatggctgcttatggtgacaatcatagattgttatcataaagcgaattggattggccatccggtgagaatcagatcgatcatttacctgtttgtcggatttaccccattggcatcgcacacgagtgacctaatcagaatagtgttgttgataaggtactactatcaca

SEQ ID NO: 1135 - DNA, 746 bp, Human poliovirus 1
  isolate CHN-Hebei/91-2, complete genome.1
ttaaaacagctctggggttgttcccaccccagaggcccacgtggcggccagtactctggtactacggtacctttgtacgcctgttttatactccctcccccatgcaacattagaagcaattcacaaagttcaatagagggggtacaaaccagtaccaccacgaacaagcacttctgtttccccggtgatctcgtataggccgtacccacggctgaaaacaagtgatccgttatccgcttaggtacttcgagaaacctagtatcaccttgggatcttcgacgcgttgcactcagcactctaccccgagtgtagcttaggctgatgagtctgggcattccccaccggtgacggtggcccaggctgcgttggcggcctacccatggctaacgccatgggacgctagttgtgaacaaggtgtgaagagcctattgagctacctaagagtcctccggcccctgaatgcggctaatcccaaccacggagcaagtgccttcaatccagagggtggcttgtcgtaacgcgcaagtctgtggcggaaccgactactttgggtgtccgtgtttccttttatttttattacggctgcttatggtgacaatcattgattgccatcataaagcgagttggattggccatccggtgaaagttaagtatctcgtccacttatctgttggacttactccattaactcaactcacgcctgatttgatatctatagtgttattgatttggaaaaagctatcata

SEQ ID NO: 1136 - DNA, 746 bp, Human poliovirus 3
  strain SWI10947, complete genome.1
ttaaaacagctctggggttgttcccaccccagaggcccacgtggcggctagtactccggtatcacggtacccttgtacgcctgttttatactcccttccccgtaacttagaagtatacaaaccaagttcaatagaagggggtacaaaccagtaccaccacgaacaagcacttctgtttccccggtgaagttgcatagattgtccccacggtcgaaagcgactgatccgttatccgctcttgtacttcgggaagcctagtatcaccttcggatcttcgatgcgttgcgctcagcactcaaccccagagtgtagcttaggtcgatgagtctggacgaacctcactggtgacagtggtccaggctgcgttggcggcctacctgtggcccaaagccacaggacgctagttgtgaacaaggtgtgaagagcctactgagctacatgagagtcctccggcccctgaatgcggctaatcccaaccacggagcaggtggtcacaaaccagtggtttgcctgtcgtaacgcgaaagtctgtggcggaaccgactactttgggtgtccgtgtttccttttattcttattatggctgcttatggtgacaatcttagattgttatcataaagcgaattggattggccatccggggaaaattaagcatatcatacacttgtttgttggattcacccctctgattacacatactcttggcttgattaggattgttgcattgataagacactattgttgca

SEQ ID NO: 1137 - DNA, 746 bp, Unknown
  Description of Unknown: Human coxsackievirus A20, strain CVA20b-Cecil polyprotein gene,1 sequence
ttaaaacagcctgtgggttgttcccaccccagaggcccacgtggcggccagtactccggtatcacggtacccttgtacgcctgttttatactcccttccccagtaatttagaagcaattaaaccaagttcaatagaagggggtacaaaccagtaccaccacgaacaagcactcctgtttccccggtgacgttgtatatactgtacccacggtagaaagcgaccgatccgttatccgctcttgtacttcgagaagcccagtaccatcttggaatcttcgatgcgttgcgctcagcactcaaccccagagtgtagcttaggtcgatgagtctggacaatcctcaccggcgacggtggtccaggctgcgttggcggcctacctgtggcccaaagccacaggacgctagttgtgaacaaggtgcgaagagcctattgagctacaagagagtcctccggcccctgaatgcggctaatcccaaccacggagctggtgaccacaaaccagtggttaacctgtcgtaatgcgcaagtctgtggcggaaccgactactttgggtgtccgtgtttcctttatttttattatggctgcttatggtgacaatcatagattgttatcataaagcgacttggattggccatccagtgaaagcaaaacaatttatctacttgtttgttgaattcactctattgaccacccacttactaagtcttattaaaattctcttgttgattagattaacacaccaca

SEQ ID NO: 1138 - DNA, 746 bp, Human poliovirus 2
  isolate T10-259, complete genome.1
ttaaaacagctctggggttgttcccaccccagaggcccacgtggcggctagtactccggtatcacggtacccttgtacgcctgttttatactcccttcccccgtaacttagaagaaataaaccaagttcaatagaagggggtacaaaccagtaccaccacgaacaagcacttctgtttccccggtgaagttgtataaactgtatccacggttgaaggcgactgatccgttatccgcttttgtacttcgagaagcctagtatcatcttggaatcttcgatgcgttgcgctcagcactcaaccccagagtgtagcttgggctgatgagtctggacacccctcaccggtgacggtggtccaggctgcgttggcggcctacctgtggcccaaagccacaggacgctagttgtgaacaaggtgtgaagagcctattgagctacgaaagagtcctccggcccctgaatgcggctaatcctaaccacggagcaagggtgcgcaaaccagtgcatgccttgtcgtaacgcgcaagtctgtggcggaaccgactactttgggtgtccgtgtttccttttattcttataatggctgcttatggtgacaatcatagattgttatcataaagcgaattggattggccatccggcgaaagtgaaatacattgtttatctttttgttggattcactccaaacacttccccttcttttaaactcatcactacggtcttgttgatcagagactcatatcaca

SEQ ID NO: 1139 - DNA, 746 bp, Human poliovirus 2
  isolate T09-216, complete genome.1
ttaaaacagctctggggttgttcccaacccagaggcccacgtggcggctagtactctggtatcatggtacccttgtacgcctgttttatactcccttaccccgtaacttagaagcaataaaccaagttcaatagaagggggtacaaaccagtaccaccgcgaacaagcacttctgttgccccggtgaagttgcatagactgtgcccacggttaaaagcgactgatccgttatccgctcttgtacttcgagaaacctagtatcatcttggaatcttcgatgcgttgcgctcaacactcgaccccagagtgtagcttaggtcgatgagtctggacactcctcactggtgacagtggtccaggctgcgttggcggcctacctgtggcccaaagccacaggacgctagtagtgaacaaggtgtgaagagtctattgagctacaagtgagtcctccggcccctgaatgcggctaatcccaaccacggagcaagtgctcacactccagtgagtagcttgtcgtaacgggtaactctgtggcggaaccgactactttgggtgtccgtgtttccttttattcttataatggctgcttatggtgacaatcatagattgttatcataaagcgaattggattggccatccggtgaaagtgaaatactttgcttaactttttgttggattcactccagtcactttcctttcttttaaactcatcaccacagtcttgttgttcagagactcatatcaca

SEQ ID NO: 1140 - DNA, 746 bp, Human poliovirus 2
  strain NIE0611197, complete genome.1
ttaaaacagctctggggttgttcccaccccagaggcccacgtggcggccagtactctggtattacggtacctttgtacgcctgttttatactccctccctcgtaacttagaagaaacaaatcaagttcaacaggagggggtacaaaccagtaccaccacgaacaagcacttctgtctccccggtgacgttgcatagactgtacccacggtcgaaagcgattgatccgttatccgctcttgtacttcgagaagcctagtatcatcttggaatcttcgatgcgttgcgctcagcactcaaccccagagtgtagcttaggtcgatgagtctggacgttccccaccggcgacggtggtccaggctgcgttggcggcctacctgtggcccaaagccacaggacgctagttgtgaacaaggtgtgaagagcctattgagctacaggagagtcctccggcccctgaatgcggctaatcccaaccacggagcaggggtgcataaaccaatgcataccttgtcgtaacgcgcaagtctgtggcggaaccgactactttgggtgtccgtgtttccttttattttttcattggctgcttatggtgacaatcatagattgttatcataaagcgacttggattggccatccggtgagagtgaaatacattgtttacttgttcattggatttactccactcaactctttcgcttacaaactcattacaacaactctgttgattgaaacaacaatactaca

SEQ ID NO: 1141 - DNA, 746 bp, Poliovirus type 3
  strain 23127 complete genome.1
ttaaaacagctctggggttgttcccaccccagaggcccacgtggcggctagtacactggtatcacggtacccttgtacgcctgttttatactcccttccccgtaacttagaagtatacaagccaagttcaatagaagggggtacaaaccagtaccaccacgaacaagcacttctgtttccccggtgaagttgcatagattgttcccacggtcgaaagcgactgatccgttacccgctcatgtacttcgggaagcctagtatcacttcggactcttcgatgcgttgcgctcagcactcaaccccagagtgtagcttaggtcgatgagtctggacaaacctcactggcgacagtggtccaggctgcgttggcggcctacctgtggcccaaagccacaggacgctagttgtgaacaaggtgtgaagagcctactgagctacatgagagtcctccggcccctgaatgcggctaatctcaaccacggagcaggtagtcacaaaccagtgatttgcctgtcgtaacgcgaaagtctgtggcggaaccgactactttgggtgtccgtgtttccttttattctcattatggctgcttatggtgacaatcctagattgttatcataaagtgagctggattggccatccggtgaaaatcaagcacattatatatttgtttgttgggtttaaccctctgattgcacgcactcttggcttggttaggattattgtgtggaaaaggcaccatagttaca

SEQ ID NO: 1142 - DNA, 746 bp, Human echovirus
  4, strain AUS250G, complete genome.1
ttaaaacagcctgtgggttgctcccacccacagggcccactgggcgtcagcacactggtatcaaggtacctttgtgcgcctgttttacaaaccctccccccccttgtaacaaacttagaagcaatgcacaccgatcaatagcgggcgcggcacgccagctgcgtcttgatcaagcacttctgtctccccggaccgagtatcaatagactgcttgcgtggttgaaggagaaagcgtccgttacccgaccaactacttcgagaagcccagtagcgccatggaagctgcgaagcgtttcgctcagcacacccccagtgtagatcaggtcgatgagtcaccgcattccccacgggcgaccgtggcggtggctgcgttggcggcctgcctacggggtaacccgtaggacgcttcaatgtagacatggtgcgaagagtcgattgagctagttggtaatcctccggcccctgaatgcggctaatcctaactgcggagcacgtgccttcaacccagagggtggcgtgtcgtaacgggcaactctgcagcggaaccgactactttgggtgtccgtgtttctttttattttgtactggctgcttatggtgacaattgaaggattgttaccatatagctattggattggccatccggtgcctaacagagcaattatttacctctttgttgggttcgtaccattcaataaggctaattaccaaatcttgtgttacatcctcagattgaacacatcgaa

SEQ ID NO: 1143 - DNA, 747 bp, Human cosavirus
  D1 polyprotein gene, complete cds.1
tggcagtccttgaaacgtgtggtgcgacgtctaaccattatggcagtgggtggagtactgcaaagatgtcaccgtgctttacacggtttttgaaccccacaccggctgtttggcgcttgcaggacagtaggtatattttctttcatttctcttttctagccgcgtaggttctatctacgcgggcggagtgatactcccgctccttcttggacaggcggcctccacgctctttgtggatcttaaggctgccaagtcactggtgtttgaagtgaagaatggagagacactagggcgtttcatgtggctttgccagggattgtagcgatgctgtgtgtgtgtgcggatttcccctcgtggcgacacgagcctcacaggccaaaagccctgtccgaaaggacccacacagtggggttgccccgacccctcccttcaaagctttgtgtaaacaaacttttgtttagactttcttaagcttctctcacatcaggccccaaagatgtcctgaaggtaccctgtgtatctgaggatgagcaccaccaactacccggacttgtgggacgtgtcccacagacgcatgtggtattccagccccctccttttgaggagggggcttttgctcgctcagcacaggatctgatcaggagattcatctctggtgctttacaccagagcatggatttaaaaattgcccaaggcctggcaaacaacctaggggactaggttttctctattttaaaagatgtcaat

SEQ ID NO: 1144 - DNA, 747 bp, Human enterovirus sp.
  71,strain EV71/Xiamen/2009, complete genome.1
ttaaaacagcctgtgggttgcacccactcacaggacccacgtggtgctagcactctggttccacggaacctttgtgcgcctgttttacgtcccctccccaatttgtaacttagaagcaatttacaacactgatcaatagcaggcatggcgcaccagctatgtcttgatcaagcacttccgtttccccggaccgagtatcaatagactgttcacacggttgaaggagaaagcgtccgttatccggctaactacttcgagaaacccagtagcgccattgaaactgcagagtgtttcgctccacacttcccccgtgtagatcaggtcgatgagtcactgtaatccccacgggcgaccgtgacagtggctgcgttggcggcctgcctatggggcaacccataggacgctctaatgtggacatggtgcgaagagtctattgagctagttagtagtcctccggcccctgaatgcggctaatcctaactgcggagcacatgccttcaatccagagggtagtgtgtcgtaatgggcaactctgcagcggaaccgactactttgggtgtccgtgtttccttttattctcacattggctgcttatggtgacaattacagaattgttaccatatagctattggattggccatccggtgtgcaatagagctattatatacctatttgttggctttgtaccactaaccttaaaatctgcaaccactctcgagtatatattgacccttaatacaatcaaac

SEQ ID NO: 1145 - DNA, 747 bp, Unknown
  Description of Unknown: Human coxsackievirus A10, strain CVA10/SD/CHN/09, complete genome.1 sequence
tttaaaacagcctgtgggttgtacccacccacagggcccactgggcgctagcactccgattctgcggaatctttgtgcgcctgttttataaccctcccccgaaacttgcaacttagaagttatgtacgttactgatcaacagcaggcgtggcacaccagccatgtcttgatcaagcacttctgtacccccggactgagtatcaatagactgctcacgtggtcgaaggagaaaacgttcgttatccggctaactacctcgagaaacctagtaacgccattgaaactgcggagtgtttcgctcagcacttcccccgtgtagatcaggtcgatgagtcactgcttaccccacgggcgaccgtggcagtggctgcgttggcggcctgcctatggggcaacccataggacgctctaaagtggacatggtgcgaagagtctattgagctagttagtagtcctccggcccctgaatgcggctaatcctaactgcggagcgcatgccttcaaaccagaaggtggtgcgtcgtaacgggtaactctgcagcggaaccgactactttgggtgtccgtgtttctcttattctcataatggctgcttatggtgacaatcgaggaattgttaccatatagctattggattggccatccggtgtgcaacagagctattatctacttgtttattggatacattccattaacacttaaatccttcaatacattgcactatattctaacactgaacgcaagaaa

SEQ ID NO: 1146 - DNA, 747 bp, Coxsackievirus
  A10 gene for polyprotein, polyprotein region,strain1
tttaaaacagcctgtgggttgtacccacccacagggcccactgggcgccagcactctgattctacggaatctttgtgcgcctgttttacaacccttcccaaaatctgcaacttagaagttatgcacattattgatcaatagcaggcgtggcacaccagtcatgtcttgatcgagcacttctgtatccccggactgagtatcaatagactgctcacgtggtcgaaggagaaaacgttcgttatccggctaactacttcgagaagcctagtaacaccgttgaaactgcggagcgtttcgttcagcacttcccccgtgtagatcaggtcgatgagtcactgcttaccccacgggcgaccgtggcagtggctgcgttggcggcctgcctatggggcaacccataggacgctctaaagtggacatggtgcgaagagcctattgagctagttagtagtcctccggcccctgaatgcggctaatcctaactgcggagcgcatgccctcacgccagagggtggtgcgtcgtaacgggcaactctgcagcggaaccgactactttgggtgtccgtgtttctttttattctcattatggctgcttatggtgacaattaaggaattgttaccatatagctattggattggccatccggtgtgcaacagagctattatctacttatttgttggatacattccattaacacttaaatcccttaacacattgcaatacattctaacactgaacgcaagaaa

SEQ ID NO: 1147 - DNA, 747 bp, Enterovirus sp.
  A71,strain USA/2018-23296, complete genome.1
ttaaaacagcctgtgggttgtacccacccacagggcccaccgggcgctagcactctgattccacggaatctttgtgcgcctgttttataacccccctccccacctcgcaacttagaagcaacgcgcatcactgatcaacagcaggcatggcgcgccagccatgtcttgatcaagcacttctgtttccccggactgagtatcaatagactgcttacgcggttgaaggagaaaacgttcgttacccggctaactacttcgagaaacttagtaacaccatcgaagctgcagggtgtttcgctcagcacttcccccgtgtagatcaggccgatgagtcaccgcaatccccacgggcgaccgtggcggtggctgcgttggcggcctgcctatggggcaacccataggacgccctaaagtggacatggtgcgaagagtctattgagctagttagtagtcctccggcccctgaatgcggctaatcctaactgcggagcacataccctcaagccagagggtggtgtgtcgtaacgggtaactctgcagcggaaccgactactttgggtgtccgtgtttccttttattcttactgtggctgcttatggtgacaattcaagagttgttaccatatagctattggattggccatccggtgtctaacagagctattgtgtacttatttgttgggtacgttccattatcttacacatcccttgacacattacattttattgtgaagctaaatacaagaag

SEQ ID NO: 1148 - DNA, 747 bp, Unknown
  Description of Unknown: Human coxsackievirus A5, strain CVA5/SD/CHN/09, complete genome.1
tttaaaacagcctgtgggttgtacccacccacagggcccactgggcgctagcactctggtactgcggtacctttgtgcgcctgttttatctccccagacccccgcaacgtcacattagaagatagacaatacgaccaatagtcagtggggcaacccagcctcactttggtcaagtacctctgtttccccgggcttagtaccaataggctgcttgcgcggctgaaggggaacgcgcccgttatccggctaactacttcgagaaacctagtaccaccatggaagttgccgagtgtttcgctcagcacaaccccagtgtagatcaggtcgatgagtcaccgtacaccccacgggcgaccgtgacggtggctgcgttggcggcctgcccatggtgcacaccatgggacgctctaatacagacatggtgcgaagagtctattgagctagttagtagtcctccggcccctgaatgcggctaatcctaactgtggagcatgcgctctcaacccagagagtagcgtgtcgtaacgggcaactctgcagcggaaccgactactttgggtgtccgtgtttccttttattcttatattggctgcttatggtgacaattgagagattgttaccatatagctattggattggccatccggtgtgcaatagagctattgtatattcttttgttggctttgtgccattagattatactgcaattgctactttaagatacatcttgtttctgaacacagcaaa

SEQ ID NO: 1149 - DNA, 747 bp, Coxsackievirus
  A5 gene for polyprotein, polyprotein region,strain1
tttaaaacagcctgtgggttgtacccacccacagggcccactgggcgctagcacactggtattacggtacccttgtgcgcctgttttatcctccctggcccccgtaataatgtattagaagtcttgcaacgtgaccaatagctagtaaagcaacccagctttacttgggtcaagtacttctgttaccccggacctagtaccaataggctgctcgcgcggctgaaggggaaaacgttcgttatccggctaactacttcgggaaacccagtaccatcatgaatgttgcggagtgtttcgctcagcactaccccagtgtagatcaggccgatgagtcaccgtacaccccacgggcgaccgtgacggtggctgcgttggcggcctgcccatggcacctgccatgggacgctctaatacggacatggtgtgaagagtctactgagctagttagtagtcctccggcccctgaatgcggctaatcctaactgcggagcacgcgcccccaatccagagggtagcgtgtcgtaatgggcaactctgcagcggaaccgactactttgggtgtccgtgtttccttttattcttacactggctgcttatggtgacaattgagagattgttgccatatagctattggattggccatccggtgagcaatagagcgattatctattcttttgttggatttgtgccattagattacactgccatcatcacactgaagtacattttattgttaaacacaacaaa

SEQ ID NO: 1150 - DNA, 747 bp, Coxsackievirus
  A5, complete genome.1
ttttaaaacaggctgtgggttgtacccacccgcagggcccactgggcgctagcactctggtaccacggtacctttgtgcgcctgttttatctccccaaaccccgtaacgctacattagaagttaaacaatatgaccgatagtcagtggggcaacccagcctcactttggtcaagcacttctgttctcccgggcttagtaccaataagctgctcgcgcggctgaaggggaacgcgcccgttatccggctaactacttcgagaaacctagtaccaccatggaagttgcagagtgtttcgctcagcactaccccagtgtagatcaggctgatgagtcaccgtgcaccccacgggcgaccgtgacggtgactgcgttggcggcctgcccatggtgtataccatgggacgctctaatacagacatggtgcgaagagtctattgagctagttagtagtcctccggcccctgaatgcggctaatcctaactgcggagcacgcgctctcaacccagagagtagcgtgtcgtaacgggtaactctgcagcggaaccgactactttgggtgtccgtgtttctttttattcttacattggctgcttatggtgacaattgagagattgttaccatatagctattggattggccatccggtgtgtaacagagctatcatatattcttttgttggcttcgtgccactagattatactgcaattgttactttaaggtacatcttacttctgaatacggtaaa

SEQ ID NO: 1151 - DNA, 747 bp, Enterovirus A
  strain A2 R1580/XY/CHN/2017, complete genome.1
tttaaaacagcctgtgggttgtacccacccacagggcccactgggcgttagcacactgattctacggaatctttgtgcgcctgttttatatccctcccctaaaatagtaatttagacgttgaacatttacacgaccaatagtgggcgtggcgcaccagtcacgtcttggtcaagcactcctgttcccccggaccgagtatcaataggctgctcacgtggctgaaggagaaagtgttcgttatccggctaactacttcgggaaacccagtaacaccatgaaagttgcagagtgtttcgttcagcacttcccccgtgtagatcaggctgatgagtcactgcaaaccccacgggcgaccgtggcagtggctgcgttggcggcctgcctatggggtaacccataggacgctctaatacagacatggtgcgaagagtctactgagctagttagtattcctccggcccctgaatgcggctaatcctaactgcggagcacatgccctcaatccagagggtggtgtgtcgtaatgggcaactctgcagcggaaccgactactttgggtgtccgtgtttccttttattcttatactggctgcttatggtgacaattgaaaagttgttaccatatagctattggattggccatccggtgaataacagagctttggtttatcagttcattgggttcgtgcccttatcatctacagcttacacaactttggtgtacttgttatatcttaatagtaagaa

SEQ ID NO: 1152 - DNA, 747 bp, Coxsackievirus
  A8,isolate CV-A8/P82/2013/China, complete genome.1
ttaaaacagcctgtgggttgttcccactcacagggcccactgggcgctagcacactgattctccggtacctttgtgtgcttgttttagtatccctcccccaaactcgtaacttagaagaataacacgctatcgatcaatagcaggcatggcgcaccagccatgtctcgatcaagcacttctgtttccccggacagagtatcaatagactactcacgtggttgaaggagaaaacgtccgttatccggctaactacttcgagaaacctagtaacaccattgaagctgcagagcgtttcgttcagcacttaccccgtgtagatcaggtcgatgagtcactgcattccccacgggcgaccgtggcagtggctgcgttggcggcctgcctatggggtcacccataggacgctctaatgtggacatggtgcgaagagtctattgagctagttagtagtcctccggcccctgaatgcggctaatcctaactgcggagcgcataccctcaaaccagggggtagtgcgtcgtaacgggcaactctgcagcggaaccgactactttgggtgtccgtgtttccttttattttcttactggctgcttatggtgacaattgaagaattgttgccatatagctattggattggccatccggtgtgtaacagagcaatcatctatttgtttgccgggtacatcccattaacgctcaactcttttagtacattacagtatatactaatcctgaatacaagaaa

SEQ ID NO: 1153 - DNA, 747 bp, Enterovirus sp.
  A114,strain V13-0285, partial genome.1
ttaaaacagcctgtgggttgttcccacccacagggcccactgggcgctagcactctggttctccggaacctttgtgcgcctgttttgaaaccccctcccccaactcgaaacgtagaagtaatgtacactactgatcagtagcaggcgtggcgcaccagccatgtctcgatcaagcacttctgtttccccggactgagtatcaatagactgctcacgcggttgaaggtgaaaacgtccgttacccggctaactacttcgagaaacctagtagcaccatagaaactgcagagtgtttcgctcagcacttcccccgtgtagatcaggtcgatgagtcactgcaatccccacgggtgaccgtggcagtggctgcgttggcggcctgcctatggggcaacccataggacgctctaaggtggacatggtgtgaagagtctattgagctagttagtagtcctccggcccctgaatgcggctaatcctaactgtggagcgcatactcccaaaccagggagcagtgcgtcgtaacgggcaactccgcagcggaaccgactactttgggtgtccgtgtttccttttattcctatactggctgcttatggtgacaattgagagattgttaccatatagctattggattggccatccagtgtgtaatagagcaatcatttaccaatttgttggatttactccattaacccacacgtctctcaacacactacatttcatcttactactgaacactagaaa

SEQ ID NO: 1154 - DNA, 747 bp, Enterovirus sp.
  C96,isolate 127/SD/CHN/1991, complete genome.1
ttaaaacagctctggggttgttcccaccccagaggcccacgtggcggccagtacaccggtattacggtacccttgtacgcctgttttatactccctacccctgcaacttagaagcaaataatccaagttcaatagtagggggtacaaaccagtaccaccacgaacaagcacttctgtttccccggtgatgttgtatagactgtacccacggttgaaaacaattgatccgttacccgctcttgtacttcgagaagcctagtatcatcttggaaccttcgatgcgttgcgctcagcactcaaccccagagtgtagcttgggtcgatgagtctggacaatccacaccggcgacggtggtccaggctgcgttggcggcctacctgtggcccaaagccacaggacgctagttgtgaacaaggtgtgaagagcctattgagctacaagagagtcctccggcccctgaatgcggctaatcccaaccacggagcaggtgatcacaacccagtgattagcctgtcgtaatgcgtaagtctgtggcggaaccgactactttgggtgaccgtgtttccttttatttttattgtggctgcttatggtgacaatcttagattgttatcataaagcgatttggattggccatccggtgaaagttaaacacattatttacttgtttgttggattcactccgttgtcctctcgcactacgtatattattaacgctgtgctattaattaggtcaatacatcaca

SEQ ID NO: 1155 - DNA, 747 bp, Human enterovirus sp.
  96,isolate FIN04-7, complete genome.1
ttaaaacagcctgtgggttgttcccaccccagaggcccacgtggcggccagtacaccggtattacggtacccttgtacgcctgttttatacttccttcccccgtaacttagaagtttacaaaccaagttcaatagaagggggtacaaaccagtaccaccacgaacaagcacttctgtttccccggtgagtttgcatagactgtatccacggttgaaagtgaacgatccgttacccgctcttgtacttcgagaagcctagtaaccccttggaatcttcgatgcgttgcgctcagcactcaaacccagagtgtagcttaggtcgatgagtctggacactcctcaccggtgacggtggtccaggctgcgttggcggcctacctgtggtccaaagccacaggacgctagttgtgaacaaggtgtgaagagcctattgagctacttgagagtcctccggcccctgaatgcggctaatcctaaccatggatcaggtggtcacaatccagtgactggcctgtcgtaatgcgcaagtccgtggcggaaccgactactttgggtgtccgtgtttccttttattcttataatggctgcttatggtgacaatcatagattgttatcatatagcgaattggattggccatccggtgtgaacaaaacacttgattcacttgttggttgaatttgtttcattaattgaacacataccagagctcatttgattggcatttttgcttagacaattgtaccaca

SEQ ID NO: 1156 - DNA, 747 bp, Unknown
  Description of Unknown: Human coxsackievirus A11, isolate CV-A11_67874, complete genome.1 sequence
ttaaaacagctctggggttgttcccaccccagaggcccacgtggcggctagtacaccggtatcacggtacccttgtacgcctgttttatactcccttcccccagtaacttagaagtaataaaccaagttcaatagaagggggtacaaaccagtaccaccatgaacaagcacttctgttcccccggtgaggttgtatagactgtgcccacggttgaaagcgaccgatccgttatccgctcttgtacttcgagaagcctagtatcaccttggaatcttcgatgcattgcgttcagcacttgatcccggagtgtagcttaggccgatgagtctggacgttccccaccggtgacggtggtccaggctgcgttggcggcctacctgtggtccaaagccacaggacgctagttgtgaacaaggtgtgaagagcctattgagctacatgagagtcctccggcccctgaatgcggctaatcccaaccacggagcagatggttgcaatccagcggctagtctgtcgtaacgcgcaagtctgtggcggaaccgactactttgggtgtccgtgtttccttttatctttataatggctgcttatggtgacaatcattgattgttgccataaagcgacttggattggccatccggtgaaaatcagatcgattatctacttgtttattggattcacacccttatctatatacacgctaagtttgatcagagtcaccttgttaattagatattattaccacg

SEQ ID NO: 1157 - DNA, 747 bp, Human enterovirus sp.
  96,strain 09228C1, complete genome.1
ttaaaacagctctggggttgttcccaccccagaggcccacgtggcggctagtactccggtatcacggtacccttgtacgcctgttttatactccctacccctgcaacttagaagctagtaactcaagttcaatagtagggggtacaaaccagtaccaccacgaacaagcacttctgtttccccggtgatgccgtatagactgtgcccacggttgaaaacgactgacccgttatccgctcttatacttcgagaagcctagtatcatcttggaatcttcgatgcgttgcgctcagcactcaaccctagagtgtagcttaggtcgatgagtctggacattcctcaccggcgacggtggtccaggctgcgttggcggcctacctgtggcccaaagccacaggacgctagttgtgaacaaggtgtgaagagcctattgagctacaagagagtcctccggcccctgaatgcggctaatcccaaccacggagcaagtgatcacgaaccagtgattggcttgtcgtaacgcgcaagtctgtggcggaacccgactactttgggtgtccgtgtttcctttatttcatatatggctgcttatggtgacaattatagattgtcatcatagagcgaattggattggccatccggtgaaagttagacatattgtttacctatttgttggctttacatccttcaacctccacaccccgtattttgttaaggttgtgttgtcgatcagatcactataccaca

SEQ ID NO: 1158 - DNA, 747 bp, Unknown
  Description of Unknown: Human coxsackievirus A13, strain ARG98-10613, complete genome.1 sequence
ttaaaacagcctgtgggttgttcccaccccagaggcccacgtggcggccagtactccggtatcacggtacccttgtacgcctgttttatacccccttccccgtaacttagaagtaaacaaaaccaagttcaatagaaggcggtacaaaccagtgccaccatgaacaagcacttctgtttccccggtgatgttgtatagactgtttccacggttgaaagcgactgatccgttatccgctcaagtacttcgggaagcctagtatcatcttggaatcttcgatgcgttgcgttcagcactcaacccccgagtgtagcttaggtcgatgagtctggacattcctcaccggtgacggtggtccaggctgcgttggcggcctacctgtggcccaaaaccacaggacgctagttgtgaacaaggtgtgaagagcctactgagctacttgagagtcctccggcccctgaatgcggctaatcctaaccacggatcaggtgattgcaaaccagcagttggcctgtcgtaacgcgcaagtctgtggcggaaccgactactttgggtgtccgtgtttccttttatttttccattggctgcttatggtgacaatcgtagattgttgtcataaagcgaattggattggccatccggtgaaagtcaagtacattatttatttatttgtgggttttactcctataacagcaaatacccttcatcttatcaccatcacactactgattagatatcactaccaca

SEQ ID NO: 1159 - DNA, 747 bp, Unknown
  Description of Unknown: Human coxsackievirus A18 genomic RNA, complete genome,strain:1 sequence
ttaaaacagctctggggttgttcccaccccagaggcccacgtggcggccagtacactggtattacggtacctttgtacgcctgttttatgctcccttcccctgcaacttagaagattacaaaccaagttcaatagaagggggtgcaaaccagtaccaccacgaacaagcacttctgtttccccggtgaacttgtatagactgtacccacggtcgaaaacgagtgatccgttatccgctcttgtacttcgagaagcccagtaccttcttgggatcattgatgcgttgcgctcagcactcgaccccggagtgtagcttaggctgatgagtctggacatccctcaccggcgacggtggtccaggctgcgttggcggcctacctgtggtccaaagccacaggacgctaaatgtgaacaaggtgtgaagagcctattgagctacatgagagtcctccggcccctgaatgcggctaatcctaaccacggagcaggtggttgcaaaccagcaattggcctgtcgtaatgcgtaagtctgtggcggaaccgactactttgggtgtccgtgtttctctttatttttacaatggctgcttatggtgacaatcttagattgttgtcataaagcgaattggattggccatccggtgaagataaagcatatcatttatctatttattggattcactccattaaactcttggacttatcatttaatacaagtagtgttattgataagaagtgttcaccaca

SEQ ID NO: 1160 - DNA, 747 bp, Unknown
  Description of Unknown: Human coxsackievirus A13 strain BAN99-10430, complete genome.1 sequence
ttaaaacagcctgtgggttgttcccaccccagaggcccacgtggcggctagtactccggtattacggtacccttgtacgcctgttttatacccccttcccccagaaacttagacgctatgaaaccaagttcaataggagggggcacgaaccagtgtcaccacgaacaagcacttctgtttccccggtgattttacataagctgtacccacggctgaaagtgaatgatccgttatccgcttgggtacttcgagaagcctagtaccacctttggatcttcgatgcgttgcgctcagcactctaccccgagtgtagcttaggtcgatgagtctgggcataccccaccggtgacggtggcccaggctgcgttggcggcctacccatggttaacaccatgggacgctagttgtgaacaaggtgtgaagagcctattgagctactcaagagtcctccggcccctgaatgcggctaatcctaaccatggagcaggtgctttcaatccagaaagtggcctgtcgtaatgcgtaagtccgtggcggaaccgactactttgggtgtccgtgtttccttttttacttttgtatggctgtttatggtgacaatcatagattgttatcataaagcgaattggattggccatccggtaaaaattaaacacatcatttatctatttgttggattcgctccaatcacttctaaaacacttcagttgatacgtgtagtattaataatcaggctattgtatcaca

SEQ ID NO: 1161 - DNA, 747 bp, Unknown
  Description of Unknown: Human coxsackievirus A13, strain USA/Ca98-10615, complete genome.1 sequence
ttaaaacagcctgtgggttgttcccaccccagaggcccacgtggcggctagtacaccggtatcacggtacccttgtacgcctgttttatactcccttcccccgtaacttagaagtataacaaccaagttcaatagaagggggtacaaaccagtaccaccacgaacaagcacctctgtttccccggtgaacttgcatagactgtgcccacggttgaaagcgagcgatccgttacccgctcttgtacttcgagaagcctagtattatcttggaatcattgatgcgttgcgctcagcactcaaccccagagtgtagcttaggtcgatgagtctggacactcctcaccggtgacggtggtccaggctgcgttggcggcctacctgtggcccatggtcacaggacgctaaatgtgaacaaggtgtgaagagcctattgagctacatgagagtcctccggcccctgaatgcggttaatcctaaccacggagcaggcggttacaaaccagtaactagcctgtcgtaatgcgcaagtctgtggcggaaccgactactttgggtgaccgtgtttccttttatttttacaatggctgcttatggtgacaatctcagattgttatcataaagcgagttggattggccatccggtaaagataaagtgtattatctatctatttgttggatttactccgttaaataccagaacatatcacttgatacaagcggtattactaattaggaacttctatcaca

SEQ ID NO: 1162 - DNA, 747 bp, Unknown
  Description of Unknown: Human coxsackievirus A17 strain G12, complete genome.1 sequence
ttaaaacagctctggggttgttcccaccccagaggcccacgtggcggctagtactccggtattgcggtacccttgtacgcctgttttatactcccttcccccgtaacttagaagcaatcaaacaaagttcaatagaagggggtacaaaccagtaccaccacgaacaagcacttctgtttccccggtgaagttgtatagactgtacccacggttaaaagcaattgatccgttacccgctcttgtacttcgagaagcctagtactaccttggaatcttcgatgcgttgcgctcaacactcaaccccagagtgtagcttgggctgatgagtctggacgttccccaccggcgacggtggtccaggctgcgttggcggcctacctgtggcccaaagccacaggacgctagttgtgaacaaggtgcgaagagcctattgagctacaagagagtcctccggcccctgaatgcggctaatcccaaccacggagcaggtagttgcaagccagcaatcgacctgtcgtaacgcgtaagtctgtggcggaaccgactactttgggtgtccgtgtttccttttaattttaaactggctgcttatggtgacaatcattgattgttatcataaagcgaattggattggccatccggtgagaatcagatccattatctacttgttcattggatttactccattgacaacatacacatacgaccttattagagtcaatttactattgagacatctccaccata

SEQ ID NO: 1163 - DNA, 747 bp, Unknown
  Description of Unknown: Human coxsackievirus A17, complete genome, genomic RNA, isolate1 sequence
ttaaaacagctctggggttgttcccaccccagaggcccacgtggcggccagtacactggtatcacggtacccttgtacgcctgttttatactcccttcccccgtaacttagaagccataaatccaagttcaacagaagggggcacaaaccagtgccaccacgaacaagcacttctgtctccccggtgaagttgcatagactgtaaccacggttaaaagcgattgatccgttatccgctcatgtacttcgagaagcctagtaccaccttggaaccttcgacgcgttgcgctcagcactcaaacccagagtgtagcttaggccgatgagtctggacgttccccaccggcgacggtggtccaggctgcgttggcggcctacctgtggctcaaagccacaggacgctagttgcgaacagggtgtgaagagcctattgagctacatgagattcctccggcccctgaatgcggctaatcctaaccgcggagcaggtagttgcaagccagcaactggcctgtcgtaacgcgtaagtctgcggcggaaccgactactttgggtgtccgtgtttcctttatttcttataatggctgcttatggtgacaatcatagattgttatcataaagcgaattggattggccatccagtgaaagtcagactgattatccttctgtttgttgggtttgttccactcaattcacacactttgcacttaatcagaattgtcttattgacacgacaatatcatcact

SEQ ID NO: 1164 - DNA, 747 bp, Human poliovirus 1
  isolate 558/BRA-PE/88, complete genome.1
ttaaaacagctctggggttgttcccaccccagaggcccacgtggtggccagtactctggtattacggtacctttgtacgcctgttttatactcccttcccctgtaacttagaagcaatctaacctagttcaataggagggggtacaaaccagtaccactacgaacaagcacttctgttaccccggtgaagttgtatagactgtgcccacggtcgaaaatgactgatccgttatccgctcatgtacttcgggaagcctagtaccatcttcggatcttcgatgcgttgcgctcagcactcgaccccagagtgtagcttaggtcgatgagtctggacaatcctcactggcgacagtggtccaggctgcgttggcggcctacctgtggtccaaagccacaggacgctagttgtgaacaaggtgtgaagagcctactgagctacttgagagtcctccggcccctgaatgcggctaatcccaaccacggagcaagtagttgcaaaccagcaaccagcttgtcgtaacgcgtaagtctgtggcggaaccgactactttgggtgtccgtgtttccttttatttttacactggctgcttatggtgacaatcatagattgttatcataaggcgaattggattggccacccggtgtaagtcagatcaattgtctactcgtttgttggatatactccaataacgcactacactcttgagcttaacagagttgttctgctggcgagaagttgctatcgca

SEQ ID NO: 1165 - DNA, 747 bp, Human poliovirus 1
  isolate Pak-11, complete genome.1
acagtaaaacagctctggggttgttcccaccccagaggcccacgtggcggctagtactctggtatcgcggtacctttgtacgcctgttttatacccctaccccatgtaactttagaagcagttcaacaagttcaatagggggggtgcaaaccagcaccaccacgaacaagcacttctgtaaccccggtgaccttgtataagctgtacccacggctgaaagcgagtgatccgttatccgcttaagtacttcgagaagcctagtatcaccttagaatcttcgatgcgttgcgctcagcactctatcccgagtgtagcttaggctgatgagtctgggcgttcctcaccggcgacggtggcccaggctgcgttggcggcctacccatggctaacgccatgggacgctagatgtgaacaaggtgtgaagagcctattgagctacttaagagtcctccggcccctgaatgcggctaatcccaaccacggagcaggtgccttcaacccagagggtggcctgtcgtaacgcgcaagtctgtggcggaaccgactactttgggtgtccgtgtttccttttatcttttatatggctgcttatggtgacaatcatagattgttatcataaagcgacttggattggccatccggtaaaatacaaacacatcatttacttgtttgttggatttactccactctcccaatttactcctagcataatatccattgttttgttaacaagacattactatcaca

SEQ ID NO: 1166 - DNA, 747 bp, Poliovirus type 2
  (Lansing strain), complete genome.1
ttaaaacagctctggggttgttcccaccccagaggcccacgtggcggccagtacactggtattgcggtacctttgtacgcctgttttatactcccttcccccgtaacttagaagcacaatgtccaagttcaataggagggggtacaaaccagtaccaccacgaacaagcacttctgttcccccggtgaggctgtataggctgtttccacggctaaaagcggctgatccgttatccgctcatgtacttcgagaagcctagtatcaccttggaatcttcgatgcgttgcgctcaacactcaaccccagagtgtagcttaggtcgatgagtctggacgttcctcaccggcgacggtggtccaggctgcgttggcggcctacctgtggcccaaagccacaggacgctagttgtgaacaaggtgtgaagagcctattgagctacctgagagtcctccggcccctgaatgcggctaatcctaaccacggagcaggcagtggcaatccagcgaccagcctgtcgtaacgcgcaagttcgtggcggaaccgactactttgggtgtccgtgtttccttttatttttacaatggctgcttatggtgacaatcattgattgttatcataaagcaaattggattggccatccggtgagaatttgattattaaattactctcttgttgggattgctcctttgaaatcttgtgcactcacacctattggaattacctcattgttaagatatcatcaccact

SEQ ID NO: 1167 - DNA, 747 bp, Unknown
  Description of Unknown: Human coxsackievirus A21, strain BAN00-10467 polyprotein gene,1 sequence
ttaaaacagcctgtgggttgttcccaccccagaggcccacgtggcggctagtactctggtacccggtacccttgtacgcctgttttatatcccccttcccatgtaactttagaagcaattcactaagttcaacagggggggtgcaaaccagtaccaccacgaacaagcacttctgtttccccggtgatttcacataagctgtgcccacggccgaaagtggatgatccgttacccgcttgggtacttcgagaagcctagtatcaccttggaatcttcgacgcgttgcgttcagcgctctaacccgagtgtagcttaggctgatgagtctgggcgatccccaccggtgacggtggcccaggctgcgttggcggcctacccatggttaacgccatgggacgctagttttgaacaaggtgtgaagagcctattgagctactcaagagtcctccggcccctgaatgcggctaatcccaaccacggagcaagtgtcctcaaaccagagggtggcttgtcgtaacgcgcaagtctgtggcggaaccgactactttgggtgaccgtgtttccttttatttcatatttggctgcttatggtgacaatcacggattgttatcataaagcgaattggattggccatccggtgaaatacaagcacattatttacctttttgtcggattcattccaatagaatattcttcgccaaagttgatccaaataatcttagtgattagaagttattatttcagca

SEQ ID NO: 1168 - DNA, 747 bp, Human poliovirus 2
  strain CHA1218986, complete genome.1
ttaaaacagctctggggttgttcccaccccagaggcccacgtggcggccagtactccggtattacggtacccttgtacgcctgttttatactcccttcccctgtaacttagaagcatacaaaccaagttcaatagaagggggtacaaaccagtaccaccacgaacaagcactcctgtttccccggtgacattgcatagactgtacccacggttgaaagcgatcgatccgttacccgctcctgtacttcgagaagcctagtatcatcttggaatcttcgatgcgttgcgctcagcactcaaccccagagtgtagcttaggctgatgagtctggacgtcccccaccggcgacggtggtccaggctgcgttggcggcctacctgtggcccaaagccacaggacgctagttgtgaacaaggtgtgaagagcctattgagctacaagagagtcctccggcccctgaatgcggctaatcctaaccacggagcaggcagttgcaaaccagcaaccggcctgtcgtaacgcgcaagtctgtggcggaaccgactactttgggtgtccgtgtttccttttatttttacaatggctgcttatggtgacaatcatagattgttatcataaagcgacttggattggccatccggtgaaagtaaaacacattgtttacttgtttgttggattcactccaattaacacttttacttacaaactcattacaacaactctattaattagagataagcatcaca

SEQ ID NO: 1169 - DNA, 747 bp, Human poliovirus 2
  strain EGY88-074, complete genome.1
ttaaaacagctctggggttgttcccaccccagaggcccacgtggcggctagtacactggtattacggtacccttgtacgcctgttttatactcccttccccgtaacttagaagctatgtaatccaagttcaatagaagggggtacaaaccagtaccaccacgaacgagcacttctgtttccccggtgagattgtataagctgttcccacggccgaaaacgatcgatccgttacccgctcttgcacttcgagaagcctagtatcatcttgggatcttcgatgcgttgcgctcagcactctaccccagagtgtagcttaggtcgatgagtctggacattcctcaccggcgacggtggtccaggctgcgttggcggcctacctgtggtccaaagccacaggacgctagttgtaaacaaggtgtgaagagcctattgagctgcaagagagtcctccggcccctgaatgcggctaatcccaaccacggagcaggtggttgcaacccagtaactggcctgtcgtaacgcgtaagtctgtggcggaaccgactactttgggtgtccgtgtttccttttatttctataatggctgcttatggtgacaatcatagattgttatcataaagcgaattggattggccatccggtgagagttaagacaattatccacttgtttgttggatttacccctctgactaattacacactcaactttattaggattgtcattctagtgagatattaccatcaca

SEQ ID NO: 1170 - DNA, 747 bp, Human poliovirus 2
  gene for polyprotein, genomic RNA,isolate1
ttaaaacagctctggggatgtacccaccccagaggcccacgtggcggctagcactccggtatcacggtacccttgtgcgcctgttttatactcccttcccgtaacttagaagcacgaaaccaagttcaatagaagggggtacaaaccagtaccaccacgaacaagcacttctgtttccccggtgatgttgcatagactgctcacgcggttgaaagcgactgatccgttatccgcttgtgtacttcgagaagcctagtatcaccttggaatcttcgtcgcgttgcgctcggcacccgaccccggggtgtggcttaggctgatgagtctggacattcctcaccggtgacggtggtctaggctgcgttggcggcctacctatggctaacgccataggacgctagatgtgaacaaggtgtgaagagcctattgagctacgcaagagtcctccggcccctgaatgcggctaatcccaaccacggagcaagcgatcgcaaaccagcgattggcttgtcgtaacgcgtaagtctgtggcggaaccgactactttgggtgtccgtgtttcctgttatttttatcatggctgcttatggtgacaatctgagattgttatcataaagcgaattggattggccatccggtgagtactgtctcaggtatactgctgcttaacggaaccgctaagttattcctactcctcatttagccaactcttccagaataatacgagggtaaaataacaatactata

SEQ ID NO: 1171 - DNA, 747 bp, Human poliovirus 2
  strain NIE0611451, complete genome.1
ttaaaacagctctggggttgttcccaccccagaggcccacgtggcggctagtactccggtatcacggtacccttgtacgcctgttttacactcccttcccccgtaacttagaagaaacaaacaaagttcaatagaagggggtacaaaccagtaccaccacgaacaagcacttctgtttccccggtgacgttgtatagactgtacccacggtcgaaaacgattgatccgttatccgcttttgtacttcgagaagcctagtatcatcttggaatcttcgatgcgttgcgctcagcactcaatcccagagtgtagcttaggtcgatgagtctggacgttcctcaccggcgacggtggtccaggctgcgttggcggcctacctgtggcccaaagccacaggacgctagttgtgaacaaggtgtgaagagcctattgagctacaagagagtcctccggcccctgaatgcggctaatcctaaccacggagcaagggtgtgtgagccaacacataccttgtcgtaatgcgtaagttcgtggcggaaccgactactttgggtgtccgtgtttccttttattcttgtattggctgcttatggtgacaatcatagattgttatcataaagcgacttggattggccatccagtggaagtgaaataccttgtctacctgtctgttggttttactccatttgactaattcacttacaagcttattgctataatttttattgactaaacaacaatactaca

SEQ ID NO: 1172 - DNA, 747 bp, Human poliovirus 2
  isolate 44624/BRA2014, complete genome.1
ttaaaacagctctggggttgttcccaccccagaggcccacgtggcggctagtactctggtatcgcggtacctttgtacgcctgttttatactccccttccctgtaacttagaagcaaacaagccaagttcaatagaagggggtacaaaccagtaccaccacgaacaagcacttctgttaccccggtgaagttgtataaactgtccccacggttgaaaacgactgatccgttacccgcttttgtacttcgagaagcctagtaccatcttggaatcttcgatgcgttgcgctccgcactcaatcccagagtgtagcttaggtcgatgagtctggacagtcctcaccggcgacggtggtccaggctgcgttggcggcctacctgtggcccaaagccacaggacgctagttgtgaacaaggtgtgaagagcctattgagctacaaaagagtcctccggcccctgaatgcggctaatcctaaccatggagcaggtggttacaaaccagtaattgacctgtcgtaacgcgtaagtccgtggcggaaccgactactttgggtgtccgtgtttccttttatttttaatgcggctgcttatggtgacaatcattgattgttatcataaagcgaattggattggccatccggtgtgaataaaacttattgtctacttgtttgttggatacactccactaaacgcattcacccctagcattatttctatagtgatcaaaatcagacaattacattaca

SEQ ID NO: 1173 - DNA, 747 bp, Human poliovirus 2
  strain USA0911201, complete genome.1
ttaaaacagctctggggttgttcccaccccagaggcccacgtggcggctagcactctggtatcacggtacccttgtgcgcctgttttacaccccctccctgcaatttagaagcacaaaactaagttcaatagaagggggtacaaaccagtaccaccacgaacaagcacttctgtttccccggtgacattacatagactgctcacgcggttgaaagtgatcgatccgttacccgcttgtgtacttcgagaagcctagtatcactttgggatcttcgacgcgttgcgcccagcactcaaacccagggtgtagcttaggccgatgagtctggacgctcctcaccggcgacggtggtccaggctgcgttggcggcctacctatggctgacgccataggacgctagatgtgaacaaggtgtgaagagcctattgagctacgcaagagtcctccggcccctgaatgcggctaatcccaaccacggagcaggcggtcacaaaccagtgactggcttgtcgtaacgcgcaagtctgtggcggaaccgactactttgggtgtccgtgtttcctgttatctttattatggctgcttatggtgacaatcagagattgttaccataaagcgaattggattggccatccggtgtgtattgcattggatatacaactgtttactaaaattactgtgttatctctactttccatttaactggttaatcaggaacgatacgagaataaaacaacaacatcacg

SEQ ID NO: 1174 - DNA, 747 bp, Coxsackievirus
  B5, isolate CVB5-JZ-P50, complete genome.1
tttttaaaacagccctgtgggttgttcccacccacggggcccattgggcgctagcacactggtatcacggtacccttgtgcgcctgttttatccaccccctccccaatgtaacatagaagcacaaactaagtggtcaatagacggctcagtgcaccaactgggtttagaccaagcacttctgttaccccggactgagtatcaataggctgctcacgcggctgaaggagaaaacgttcgttacccggccaactacttcgagaagcccagtaccaccatgaaggttgcgcagtgtttcgttcagcacaaccccagtgtagatcaggtcgatgagtcaccgcaatccccacgggcgaccgtggcggtggctgcgctggcggcctgcccatggggtgacccatgggacgcttcaattccgacatggtgcgaagagcctattgagctagttggtagtcctccggcccctgaatgcggctaatcccaactgcggagcaagcacccacaaaccagtgggctgtttgtcgtaacgggcaactctgcagcggaaccgactactttgggtgtccgtgtttccttttattcctacactggctgcttatggtgacaattgaaagattgttgccatatagctattggattggccatccggtaacaaacagagctattattcacttatttgttggctttgtgccgttgaatttcaaagttataaaaaccataacctccatcttgacactcaacacagcaaa

SEQ ID NO: 1175 - DNA, 748 bp, Enterovirus sp.
  A71,isolate N7008-TW99/VP1-E98K, complete genome.1
ttaaaacagcctgtgggttgcacccactcacagggcccacgtggcgctagcactctggttctacggaacctttgtgcgcctgttttacgccccttcccccaatttgcaacttagaagcaatacacaacactggtcaacagtaggcatggcgcaccagccatgtcttgatcaagcacttctgtttccccggaccgagtatcaatagactgctcacgcggttgaaggagaaagcgtccgttatccggctaactacttcgagaaacttagtaacaccattgaagctgcagagtgtttcgctcggcacttcccccgtgtagatcaggtcgatgagtcactgcaatccccacgggtgaccgtggcagtggctgcgctggcggcctgcctatggggtaacccataggacgctctaatgcggacatggtgcgaagagtctattgagctagttagtggtcctccggcccctgaatgcggctaatcctaactgcggagcacatgccttcaatccagagggtagtgtgtcgtaatgggcaactctgcagcggaaccgactactttgggtgtccgtgtttccttttattcttatattggctgcttatggtgacaattacagaattgttaccatatagctattggattggccatccggtgtgcaatagagctattatatacctatttgttggctttgtgccactaaccttaaaatctataaccaccctcgactttatactaaccctcaatacagtcaaac

SEQ ID NO: 1176 - DNA, 748 bp, Coxsackievirus
  A4,isolate HK458564/2016 polyprotein gene, complete1
tttaaaaccaagctgtgggttgtacccactcacagggcccactgggcgctagcactctgattccgcggaatctttgtgcgcctgttttataacccctcccccgatttgtaatttagaagtaatgcacaccactgatcaacagcaagcgtggcgcgccagccatgttcagatcaaatacttctgttttcccggactgagtatcaatagactgctcacgcggttgaaggagaaaacgttcgttacccggctaactacttcgagaaacctagtagcaccatcgaaactgcagagtgtttcgctcagcactttccccgtgtagatcaggtcgatgagtcactgcaatccccacgggcgaccgtggcagtggctgcgttggcggcctgcctatgggcttgcccataggacgctctaatgtggacatggtgtgaagagtctattgagctagttggtagtcctccggcccctgaatgcggctaatcctaactgcagagcgcataccctcaatccagggggtggtgcgtcgtaacgggcaactctgcagcggaaccgactactttgggtgtccgtgtttccttttattcttatattggctgcttatggtgacaattgagagattgttgccatatagctattggattggccatccagtgtctaacagagcaattgtatacttgtttgttggattcgttccactgtcatatacatccactaacaccttatactatattacaaaattgaacacaagaaa

SEQ ID NO: 1177 - DNA, 748 bp, Human enterovirus sp.
  90, isolate F950027, complete genome.1
tttaaaacagctctagggttgttcccaccctagaggcccaagtggcggctagcactctggtattacggtacctttgtgcgcctgttttatatcccttcccccatgtaacttagaagatattaaacaaagttcaataggagggggtacaaaccagtgccaccacgaacaaacacttctgtttccccggtgaagctacatagactgttcccacggttgaaagtggcagatccgttatccgctttggtacttcgagaaacctagtaccaccttggaatcttcgatgcgttgcgctcagcactcaaccccagagtgtagcttaggtcgatgagtctggacgatcctcactggcgacagtggtccaggctgcgttggcggcctacctgtggcgaaagccacaggacgctagttgtgaacaaggtgtgaagagtctattgagctaccaaagagtcctccggcccctgaatgcggctaatcccaaccacggagcaagtgcccacaaaccagtgggtggcttgtcgtaatgcgtaagtctgtggcggaaccgactactttgggtgtccgtgtttccttttatttttatcatggctgcttatggtgacaatctaagattgttatcatatagctattggattggccatccggtgactaacagagatcttgcatacctgtttgttggttttactaaactagatatagttacatttaaaactcttctttatatcatacagttgaatagtagaaagagaaa

SEQ ID NO: 1178 - DNA, 748 bp, Enterovirus sp.
  A71 gene for polyprotein, polyprotein region,strain1
ttaaaacagcctgtgggttgcacccacccacagggcccactgggcgctagcaccctgattctgcggaatctttgtgcgcctgttttacaacccttcccccgatttgtaatttagaagcaacgaacctcaccgatcaatagtaggcgtggcgcgccagctacgtcttgatcaagcacttctgtttccccgggctgagtatcaatagactgcttgcgcggtcgaaggagaaaacgctcgttatccggctaactacttcgagaaacccagtaacaccattgaaactgcagagtgtttcgctcagcacttcccccgtgtagatcaggtcgatgagtcactgcaatccccacgggcgaccgtggcagtggctgcgttggcggcctgcctatggggcaacccataggacgctctaaggtggacatggtgtgaagagtctattgagctagttagtagtcctccggcccctgaatgcggctaatcctaactgcggagcgcatgccctcaaaccagagggtggtgcgtcgtaatgggcaactctgcagcggaaccgactactttgggtgtccgtgtttccttttattctcttaatggctgcttatggtgacaattaaggaattgttaccatatagctattggattggccatccggtgtgtagtagagctattatttatctatttgttggttttgtaccattaaacttaaggtctgtcaccactttacaatatatactgatcctcaatacggttaagc

SEQ ID NO: 1179 - DNA, 748 bp, Enterovirus sp.
  A71 partial CDS gene for polyprotein,strain1
gcgcccagtgggccctgtgggttgcacccacccacagggcccactgggcgctagcactctggcactaaggtacctttgtgcgcctgttttatttcccttcccccaaagtaatttagaagttatgcaccaacgatcaatagcaggtgtgacacaccagtcatatcttgatcaagtactcctgtttccccggaccgagtatcaataagctgctcgcgcggctgaaggagaaaacgttcgttacccgaccaactacttcgagaagcttagtaccaccatgaacgaggcagagtgtttcgttcagcacaaccccagtgtagatcaggctgatgagtcactgcaaaccccatgggcgaccatggcagtggctgcgttggcggcctgcccatggagaaatccatgggacgctctaattctgacatggtgtgaagagcctattgagctagttggtagtcctccggcccctgaatgcggctaatcctaactgcggagcacatgctcacaaaccagtgggtggtgtgtcgtaatgggtaactctgcagcggaaccgactactttgggtgtccgtgtttccttttattcttatgttggctgcttatggtgacaatcaaagaattgttaccatatagctattggattggccatccggtgtgcaacagagcaattgtttacctatttgttggttttgtaccactatcactgaagtctgtgatcactctcaaattcattctgaccctcaactcaatcaaac

SEQ ID NO: 1180 - DNA, 748 bp, Unknown
  Description of Unknown: Human coxsackievirus A13, isolate CV-A13_68095, complete genome.1 sequence
ttaaaacagctctggggttgttcccaccccagaggcccacgtggcggccagtacaccggtatcacggtacccttgtacgcctgttttatactccctttcccccgtaacttagaagcaataaaaccaagttcaatagaaagggggtacaaaccagtaccaccacgaacaagcacttctgtttccccggtgatgttgtatagactgtttccacggttgaaaacgactgatccgttatccgctcttgtacttcgagaagcctagtatcatcttgggatcttcgatgcgttgcgctcaacactcgaccccggagtgtagcttaggccgatgagtctggacgttccccaccggcgacggtggtccaggctgcgttggcggcctacctgtggtccaaagccacaggacgctagttgtgaacaaggtgtgaagagcctattgagctacttgagagtcctccggcccctgaatgcggctaatcccaaccacggagcaggtggttgcaatccagcaactagcctgtcgtaacgcgcaagtctgtggcggaaccgactactttgggtgtccgtgtttccttttatttttcattggctgcttatggtgacaatctcagattgttatcataaagcgagttggattggccatccggtgaaaatcagatcgattatttacctttttgttggatttacacctttaacattacacactttgaaactcattgaaattgtactgttgatacggtattactatcaca

SEQ ID NO: 1181 - DNA, 748 bp, Unknown
  Description of Unknown: Human coxsackievirus A13, isolate CV-A13_67001, complete genome.1 sequence
ttaaaacagctctggggttgttcccaccccagaggcccacgtggcggccagtacaccggtatcgcggtacccttgtacgcctgttttatactccctttccccgtaacttagaagcaatgaaaccaagttcaatagaaagggggtacaaaccagtaccaccacgaacaagcacttctgtctccccggtgaggtcgtatagactgttcccacggttgaaaatgactgatccgttatccgctcttgtacttcgagaagcctagtaccaccttggaatcttcgatgcgttgcgctcagcactcaaccccggagtgtagcttgggctgatgagtctggacattccccaccggcgacggtggtccaggctgcgttggcggcctacctgtggcccaaagccacaggacgctagttgtgaacaaggtgtgaagagcctattgagctacatgagagtcctccggcccctgaatgcggctaatcccaaccacggagcaggcgattgcaatccagcaattagcctgtcgtaacgcgtaagtctgtggcggaaccgactactttgggtgaccgtgtttccttttattcttacattggctgcttatggtgacaatcatagattgttatcataaagcgagttggattggccatccagtgagaattagatcgatcatctacctttttgttggatttacacctttaaaaccacacagcttgaatctcatcaaaattgtattgttgatacgacattattatcatt

SEQ ID NO: 1182 - DNA, 748 bp, Unknown
  Description of Unknown: Human coxsackievirus A24, strain PUR82-10686 polyprotein gene,1 sequence
ttaaaacagctctggggttgttcccaccccagaggcccacgtggcggccagtacaccggtatcgcggtacccttgtacgcctgttttatactcccttccccccgtaacttagaagcatataacacaagttcaatagaagggggtgcaaaccagcaccaccacgaacaagcacttctgtttccccggtgagatcacatagattgttcccacggtcgaaagtgatcagtccgttatccgctcttgtacttcgagaagcctagtaccttcttggaatcttcgatgcgttgcgctcagcactcaaacccagagtgtagcttaggccgatgagtctggacattccccaccggtgacggtggtccaggctgcgttggcggcctacctgtgacccaaagtcacaggacgctagttgtgaacaaggtgagaagagcctattgagctacaagagattcctccggcccctgaatgcggctaatcccaaccatggagcaggtggctgcaaaccagcagacggcctgtcgtaacgcgcaagtccgtggcggaaccgactactttgggtgtccgtgtttcctttattttttattgtggctgcttatggtgacaatcattgattgttatcataaagcgaattggattggccatccagcgataattaaccagaccatttactagtttgttggatttactccactgacattctaaacactcaatctcatagaagtggtgaaattaattggataatttaactaca

SEQ ID NO: 1183 - DNA, 748 bp, Unknown
  Description of Unknown: Human coxsackievirus A13 strain ARG98-10614, complete genome.1 sequence
ttaaaacagcctgtgggttgttcccaccccagaggcccacgtggcggctagtactccggtattacggtacccttgtacgcctgttttatactcccttcccccgcaacttagaagttttacaaaactcgttcaacagaagggggtacaaaccagtaccaccacgaacaagcacttctgtttccccggtgacgttgtatagactgttcccacggtcgaaagcgactgatccgttatccgctctggtacttcgggaagcctagtagcaccttgggatcttcgacgcgttgcgttcaacactcaaccccggagtgtagcttaggtcgatgagtctggacgctcctcaccggcgacggtggtccaggctgcgttggcggcctacctgtggtccaaagccacaggacgctagttgtgaacaaggtgtgaagagcctactgagctacctgagagtcctccggcccctgaatgcggctaatcctaaccacggatcaggtgattgcaaaccagcaattggcctgtcgtaatgcgcaagtctgtggcggaaccgactactttgggtgtccgtgtttccttttattttaaaaatggctgcttatggtgacaatcatagattgttatcataaagcgagttggattggccatccggtgaaagtaaagtatattatctacttgtttgtgggatttactcctataactgcatacacttatcatctcattacgatcacactattgattagatcctgttaccaca

SEQ ID NO: 1184 - DNA, 748 bp, Unknown
  Description of Unknown: Human coxsackievirus A21 strain BAN00-10542 polyprotein gene,1 sequence
ttaaaacagcctgtgggttgttcccaccccagaggcccacgtggcggctagtactctggtatcgcggtacctttgtacgcctgttttatactcccttccccatgtaactttagaagcaattcaccaagttcaatagagggggtacaagccagtaccaccacgaacaagcacttctgttaccccggtgagtttgcataagctgtgcccacggctgaaagtaaatgatccgttatccgcttgagtacttcgagaagcctagtatcaccttggaatcttcgacgcgttgcgctcaacactctaccccgagtgtagcttaggctgatgagtctgggcatcccccaccggcgacggtggcccaggctgcgttggcggcctacccatggccaacgccatgggacgctagttgtgaacaaggtgtgaagagcctattgagctactcaagagtcctccggcccctgaatgcggctaatcctaaccatggagcaagtggccccaacccaggggatggcttgtcgtaacgcgcaagtccgtggcggaaccgactactttgggtgtccgtgtttccttttattttatatatggctgcttatggtgacaatcacagattgttatcataaagcgaattggattggccatccggtgaaatataagcacattatttatatctttgctggattcgctccgttgacacattcttcaccaaagttgatttatacagtcttagtaattagaaatcaccacttcagtc

SEQ ID NO: 1185 - DNA, 748 bp, Unknown
  Description of Unknown: Human coxsackievirus A20 strain MOR83-10617 polyprotein gene,1 sequence
ttaaaacagcctgtgggttgttcccaccccagaggcccacgtggcggctagtactccggtattacggtacccttgtacgcctgttttatactcccttcccctgtaacttagaagcaccgaacacaagttcaatagaagggggtacaaaccagtaccaccacgaacaagcacttctgtttccccggtgaagttgtattaaactgttcccacggttgaaagcggctgatccgttatccgctcatgtacttcgggaagcctagtaccatcttggaatcttcgatgcgttgcgctcagcactcaaccccagagtgtagcttaggtcgatgagtctggacaaacctcactggcgacagtggtccaggctgcgttggcggcctacctgtggcccaaagccacaggacgctagttgtgaacaaggtgtgaagagcctactgagctacatgagagtcctccggcccctgaatgcggccaatcccaaccacggagcaggcgactacaagccagtggttagtctgtcgtaatgcgcaagtctgtggcggaaccgactactttgggtgtccgtgtttccttttattttgacattggctgcttatggtgacaatcatagattgttatcataaagcgaattggattggccatccggtgagagtcaaaactattatctacctttttattggatttactccactgaacgcttataccccagtccttattagacttgcattgttgattagatatcactattata

SEQ ID NO: 1186 - DNA, 748 bp, Human poliovirus 2
  isolate CHN1025 polyprotein gene, complete cds.1
ttaaaacagctctggggttgtacccaccccagaggcccacgtggcggccagcactccggtattacggtacccttgtgcgcctgttttatactccctctcccgcaacttagaagcacgaaaccaagttcaatagaagggggtacaaaccagtaccaccacgaacaagcacctctgtttccccggtgacattgcatagactgctcacgcggttgaaagtgatcgatccgttacccgcttgtgtacttcgaaaagcctagtatcgccttggaatcttcgacgcgttgcgctcagcacccgaccccggggtgtagcttaggctgatgagtctggacattcctcaccggtgacggtggtccaggctgcgttggcggcctacctatggctaacgccataggacgctagttgtgaacaaggtgtgaagagcctattgagctacataagagtcctccggcccctgaatgcggctaatcctaaccacggagcaggcggtcgcgaaccagtgactggcttgtcgtaacgcgcaagtctgtggcggaaccgactactttgggtgtccgtgtttcctgttatttttatcatggctgcttatggtgacaatcagagattgttatcataaagcgaattggattggccatccggtgagtgttgtgtcaggtatacaaccgtttgttggaaccactgtgttagctttacttctcatttaaccagttaatcaaaaacaatacgaggacaaaacaacaatactaca

SEQ ID NO: 1187 - DNA, 748 bp, Human poliovirus 2
  strain NIE1519322, complete genome.1
ttccgctcctctggggttgttcccaccccagaggcccacgtggcggctagtactccggtattacggtacccttgtacgcctgttttatactcccttccccgcaacttagaagaattaaaccaagttcaatagaagggggtacaagccagtaccaccacgaacaagcacttctgtttccccggtgacgccgtatagactgtacccacggttgaaaacgactgatccgttatccgctttcgtacttcgagaagcctagtatcatcttgggatcatcgatgcgttgcgctcagcactcaaccccggggtgtagcttaggccgatgagtctggacattcctcaccggtgacggtggtccaggctgcgttggcggcctacctgtggcccaaagccacaggacgctagttgtgaacaaggtgtgaagagcctattgagctacgaaagattcctccggcccctgaatgcggctaatcccaaccacggagcaagtgctcgcacaccagtgagtagcttgtcgtaacgggtaactctgtggcggaaccgactactttgggtgtccgtgtttcctgttatttttatcatggctgcttatggtgacaatcagagattgttatcataaagcgaattggattggccatccggtgagcgttgtgtcaggtatacaactgtttgttggaaccactgtgttagctttacttctcatttaaccaatttatcaaaaataatacgaggataaaacaacaatactaca

SEQ ID NO: 1188 - DNA, 748 bp, Human poliovirus 3
  strain NIE1219535, complete genome.1
gttaaaacagctctggggttgttcccaccccagaggcccaagtggcggctagtactccggtatcacggtacccttgtacgcctgttttatactcccttcccccgtaacttagaagagttaaaccaagttcaatagaagggggtacaaaccagtaccaccacgaacaagcacttctgtttccccggtgatattgtatagactgtacccacggtcgaaaatgattgatccgttatccgctctcatacttcgagaagcctagtatcatcttggaatcttcgatgcgttgcgctcggcactcgatcccggagtgtagcttaggtcgatgagtctggacactcctcaccggtgacggtggtccagactgcgttggcggcctacctgtggtccaaagccacaggacgctagttgtgaacaaggtgtgaagagcctattgagctatgagagagtcctccggcccctgaatgcggctaatcccaaccacggagcgagagtgcgcaagccagcgtatatctcgtcgtaacgcgcaagtctgtggcggaaccgactactttgggtgtccgtgtttccttttatttttgtattggctgcttatggtgacaatcacagattgttatcataaagcgaattggattggccatccggtgaaagtgaaatacattatttgcttatttattggattcagtccacctaattgctatactcacgaacccaccacagccgttttgttaactgaaagccggtaccaata

SEQ ID NO: 1189 - DNA, 748 bp, Human poliovirus 3
  strain PAK1019536, complete genome.1
tggggttaaaacagctctggggttgttcccaccccagaggcccacgtggcggctagtactctggtatcatggtacctttgtacgcctgttttatacccctaccccacgtaactttagaagcaactcaacaagttcaatagggggggtacaaaccagtaccaccacgaacaagcactcctgttaccccggtgatcttgcataagctgtgcccacggctgaaggcgagagatccgttatccgcttgagtacttcgagaagcctagtatcaccttgggatcttcgacgcgttgcgctcagcactccacccgagtgtagcttaggctgatgagcctgggcattccccaccggcgacggtggcccaggctgcgttggcggcctacccatggctaacaccatgggacgctagatgtgaacaaggtgtgaagagcctattgagctactcaagagtcctccggcccctgaatgcggctaatcccaaccacggagcaggtgtcttcaacccagaaggtagcctgtcgtaacgcgtaagtctgtggcggaaccgactactttgggtgtccgtgtttccttttatcttttatatggctgcttatggtgacaatcacagattgttatcataaagcgatttggattggccatccggtgaagtacaaacacattatctacttgtttgttggatttactccactcacacaccccacccccaatataacatctattgttttgttaacaagaaattactttcgaa

SEQ ID NO: 1190 - DNA, 749 bp, Human cosavirus
  B1 polyprotein gene, complete cds.1
ttgccagttttttgaaacgtgtggtttgacgtctaaccattatggcagtgggtggagtactgcaaagatgtcaccgtgctttacacggtttttgaaccccacaccggctgtttggcgcttgcaggacagcaggtttattttcttttaactctctctttctagccacacacgatctatgtgtgtgggcggagtgatactcccgttccttcttggacaggcggcctccacgccctttgtggatcttaaggctaccaagtcactggtgttggaaagtgaagagaaaggagttccttgggaactacatgtggcattgacagaggttgtagcgatgctgtgtgtgtgtgcggattacccccgtggcgacacggaccccacaggccaaaagccctgtccgaaaggacccacacagtggagcaaccccagctcccctcttcaatgttttgtgttagcaaccttggtattattttctctcaagcttccaatacaccgggccccaaagatgtcctgaaggtaccccgtgtatctgaggatgagcaccatcaactacccggacttgttctttcgagaacagacgcatgtggtaacccagccccgatcctaaggggtcggggcttttgctcactcagcacaggatctgatcaggagacctcccccccctgctttacagggggcgggggtttaaaaattgcccaaggcctggcaaataacctaggggactaggttttcctttttattttaaagttgtcaat

SEQ ID NO: 1191 - DNA, 749 bp, Human enterovirus sp.
  90 polyprotein gene, complete cds.1
ttaaaacagctcttagggttgttcccaccctagaggcccacgtggcggctagcactctggtatcacggtacctttgtgcgcctgttttatacccccctcccccatgtaacttagaagctattaaataaagttcaatagaagggggtacaaaccagtaccaccacgaacaagcacttctgtttccccggtgaagctacatagactgttcccacggttgaaagtggcagatccgttatccgctttggtacttcgagaaacctagtatcatcttggaatcttcgatgcgttgcgttcagcactcaaccccagagtgtagcttaggtcgatgagtctggacgatcctcactggcgacagtggtccaggctgcgttggcggcctacctgtggcgaaagctacaggacgctagttgtgaacaaggtgtgaagagtctattgagctatcaaagagtcctccggcccctgaatgcggctattcccaaccacggagcaagtgctcacaaaccagtgagtggcttgtcgtaacgcgcaagtctgtggcggaaccgactactttgggtgcccgtgtttccttttatttttatcatggctgcttatggtgacaatctaagattgttatcatatagctattggattggccatccggtgactaacagagatatcatatattcatttgttggttttgttaaactagactcaactacattcaagtctcttctcttcatcatacaattgaataatagaaagagaaa

SEQ ID NO: 1192 - DNA, 749 bp, Enterovirus sp.
  A90,isolate PSH40F/XJ/CHN/2011, complete genome.1
ttaaaacagctctgggggttgttcccaccctagaggcccacgtggcggctagcactctggtatcacggtacctttgtgcgcctgttttatatccctttccccatgcaacttagaagttttttaaacaaagttcaatagaagggggtacaaaccagtgccaccacgaacaagcacttctgtttccccggtgaagctgcatagactgtccccacggttgaaagcggcagatccgtcatccgctttggtacttcgagaaacctagtatcaccttggaatcttcgatgcgttgcgctcagcactcaaccccagagtgtagcttaggttgatgagtctggacaatcctcactggcgacagtggtccaggctgcgttggcggcctacctgtggtgaaaaccacaggacgctagatgtgaacaaggtgtgaagagtctattgagctaccaaagagtcctccggcccctgaatgcggctaatcctaaccacggagcaagtacccacaaaccagtgggcagcttgtcgtaacgcgcaagtctgtggcggaaccgactactttgggtgtccgtgtttcctttttattttatcatggctgcttatggtgacaatctaagattgttatcatatagctattggattggccatccggtgactaacagagatattatatacctatttgttggttttgttagattaaatactatcacattcaaaactcttctttatatcatacaattgaacagtagaaagagaaa

SEQ ID NO: 1193 - DNA, 749 bp, Human enterovirus sp.
  71isolate 237-TW86 polyprotein gene, complete1
ttaaaacagcctgtgggttgttcccacccacagggcccactgggcgctagcactctgatttcacgaaatccttgtgcgcctgttttatatcccttccccccagtctgaaacatagaagcaatgcgcatcactgatcaatagcaggcgtaacgcgccagttacgtcatgatcaagcacatctgtctccccggaccgagtatcaatagactgcttgcgcggttgaaggagaaacagttcgttacccggctaactacttcgagaagcccagtagcaccatggaagctgcagggtgtttcgctcagcacttcccccgtgtagatcaggtcgatgagtcactgcaacccccacaggcgactgtggcagtggctgcgttggcggcctgcctatggggagacccataggacgctctaatgtggacatggtgtgaagagcctattgagctagttagtagtcctccggcccctgaatgcggctaatcctaactgcggagcacacgccctcaacccagagggtagtgtgtcgtaacgggcaactctgcagcggaaccgactactttgggtgtccgtgtttcttattattcttatattggctgcttatggtgacaattacagaattgttaccatatagctattggattggccatccggtgtgcaatagagctgttatatacctatttgttggttttgtgccactgactttaaaatctatagttactcttaatttcatattggctctcaacacaattaaac

SEQ ID NO: 1194 - DNA, 749 bp, Coxsackievirus
  A16 gene for polyprotein,isolate1
ttaaaacagcctgtgggttgttcccacccacagggcccactgggcgctagcactctggtattacggtacctttgtgcgcctgttttatgccccttaccccttaaattggtaacttagaagttttacatacctgcgaccaatagcgggcatgacgcaccagccatgtcttggtcaagcacttctgttcccccggactgagtatcaatagactgctcacgcggtcgaaggagaaaacgttcgttatccggctggctacttcgagaaacccagtaacaccatgaaagttgcagagtgtttcgctcagcactacccccgtgtagatcaggtcgatgagtcactgcgaaccccacgggcgaccgtggcagtggctgcgctggcggcctgcccatggggtgacccatgggacgctctaatacagacatggtgtgaagagtctattgagctagtcagtagtcctccggcccctgaatgcggctaatcctaactgcggagcacatgccctcaatccagggggtggtgtgtcgtaacgggtaactctgcagcggaaccgactactttgggtgtccgtgtttccttttattcctatcatggctgcttatggtgacaattgaaagattgttaccatatagctactggattggccacccggtgtctaacagagctattgtttatctatttgttgggtacgtccttcttgactataaggcccttcagactcttaagtacatcttgtacctcaatcaaaagag

SEQ ID NO: 1195 - DNA, 749 bp, Coxsackievirus
  A8,isolate HZ040/SD/CHN/2015 polyprotein gene,1
ttaaaacagcctgtgggttgtacccacccacagggcccactgggcgccagcactctgattctacggaatctttgtgcgcctgttttataatcccctccccccaagtttgtaatttagaagcaaagtaccgtaacgatcaacagcaggcgtggcgcaccagccatgtctcgatcaagcacttctgttcccccggacagagtatcaatagactactcacgtggttgaaggagaaaacgtccgttatccggctaactacttcgagaaacctagtaacaccattgaaactgcagagcgtttcgctcagcacttaccccgtgtagatcaggtcgatgagtcactgcattccccacgggcgaccgtggcagtggctgcgttggcggcctgcctatggggtcacccataggacgctctaatgtggacatggtgcgaagagtctattgagctagttagtagtcctccggcccctgaatgcggctaatcctaactgcggagcgtatgccctcaaaccagggggtggtgcgtcgtaacgggtaactctgcagcggaaccgactactttgggtgtccgtgtttccttttatttccttactggctgcttatggtgacaattgaagaattgttgccatatagctattggattggccatccggtgtgtaacagagcaatcatctatttgttcgtcgggtatatcccactaacgctcaactcttttaacacattacaatacatactaatcctaaatacaagaaa

SEQ ID NO: 1196 - DNA, 749 bp, Human enterovirus sp.
  99,strain BAN00-10461 polyprotein gene, complete1
ttaaaacagcctgtgggttgttcccaccccagaggcccacgtggcggccagtactccggtattacggtacccttgtacgcctgttttatactccctttccctagtaacttagaagttgtacaattaagttcaatagaagggggtacaaaccagtaccaccacgaacaagcacttctgtttccccggtgaagttgcatagactgtccccacggttaaaagtgactgatccgttatccgctcatttacttcgggaagcctagtatcatcttgggatcttcgatgcgttgcgctcaacactcaaccccagagtgtagcttaggtcgatgagtctggacactccccactggtgacagtggtccaggctgcgttggcggcctacctgtggtccaaagccacaggacgctagtagtgaacaaggtgtgaagagcctactgagctaattgagagtcctccggcccctgaatgcggataatcctaaccacggagcaggtgatcacaatccagtgattggcctgtcgtaatgcgtgagtctgtggcggaaccgactactttgggtgtccgtgtttcctttttactcttattatggctgcttatggtgacaatcatagattgttatcataaagcgaattggattggccatccggtgagaattaaatcgctaatatatctatttgttggatttaccaaaatcaactacagaacactagccttaattcgaatcgtgttactgatcagattccaccatcaca

SEQ ID NO: 1197 - DNA, 749 bp, Unknown
  Description of Unknown: Human coxsackievirus A20 serotype CAV20a, complete genome.1
ttaaaacagctctggggttgttcccaccccagaggcccacgtggcggctagtactctggtattacggtacctttgtacgcctgttttatactcccttcccctccgtaacttagaagcatgagaatcaagttcaatagaagggggtacaaaccagtaccaccacgaacaagcacttctgtcaccccggtgaggttgtatagactgtccccacggttgaaagcgactgatccgttatccgctcaattacttcgggaagcctagtaccatcctggaatcttcgatgcgttgcgctcagcactcaaccccagagtgtagcttaggccgatgagtctggacaatcctcactggcgacagtggtccaggctgcgttggcggcctacctgtggtccaaagccacaggacgctagttgtgaacaaggtgcgaagagcctactgagctaattgagagtcctccggcccctgaatgcggctaatcccaaccacggagcaggcggttgcaaaccagcaactggcttgtcgtaacgcgaaagtctgtggcggaaccgactactttgggtgtccgtgtttccttttattcttatgatggctgcttatggtgacaatcgttgattgttatcataaagcgaattggattggccatccggtgaaaatcaaatctattgtttacctgttcattgggttcactccactaacttcacacactatatatctcattaaggtcgtattactagtaaggaattatcaccaaa

SEQ ID NO: 1198 - DNA, 749 bp, Human poliovirus 2
  strain NIE0711441, complete genome.1
ttaaaacagctctggggttgttcccaccccagaggcccacgtggcggctagtactctggtattacggtacccttgtacgcctgttttatactcccttccccgtaacttagaagaaataaaccaagttcaatagaagggggcacaaaccagtgtcaccacgaacaagcacttctgtttccccggtgatattgtatagactgtacccacggttaaaagcgattgatccgttatccgctcttgtacttcgaaaagcctagtatcatcttggaatcttcgatgcgttgcgctcaacactcaaccccagagtgtagcttaggtcgatgagtctggacattccccaccggcgacggtggtccaggctgcgttggcggcctacctgtggcccaaagccacaggacgctagttgtgaacaaggtgtgaagagcctattgagctgcaagagagtcctccggcccctgaatgcggctaatcccaaccacggagcaagtgctcacacaccagtgagtggcttgtcgtaacgcgcaagtctgtggcggaaccgactactttgggtgtccgtgtttcctgttatttttatcatggctgcttatggtgacaatcagagattgttatcataaagcgaattggattggccatccggtgagtgttgtgtcaggtatacaactgtttgttggaaccactgtgttaactttacttctcatttaaccaattaatcaaaaacaatacgaggataaaacaacaatactaca

SEQ ID NO: 1199 - DNA, 749 bp, Human poliovirus 2
  strain EGY93-034, complete genome.1
ttaaaacagctctggggttgttcccaccccagaggcccacgtggcggccagtacaccggtattacggtacccttgtacgcctgttttatactcccttccccctgtaacttagaagctcaagaatccaagttcaatagaagggggtacaaaccagtaccaccacgaacaagcacttctgtttccccggtgaagttgcatagactgttcccacggttgaaagtgactgatccgttatccgctcaactacttcgagaagcccagtatcatcttggaatcttcgatgcgttgcgctcagcactcgaccccggagtgtagcttaggctgatgagtctggacgttccccactggtgacagtggtccaggctgcgttggcggcctacctgtggtccaaagccacaggacgctagttgtgaacaaggtgtgaagagcctattgagctaattgagaatcctccggcccctgaatgcggctaatcccaaccacggagcaggtggttacaacccagtaactggcctgtcgtaacgcgtaagtctgtggcggaaccgactactttgggtgtccgtgtttccttttattcctataatggctgcttatggtgacaatcacagattgttatcataaagcgaattggattggccatccggtgagagttaagacaattatccacttgttcattggatttacccctctgactaattacacactcaaccttattagaattgtagttctagtgagatactactgtcata

SEQ ID NO: 1200 - DNA, 749 bp, Human poliovirus 2
  strain NIE0110767, complete genome.1
ttaaaacagctctggggttgttcccaccccagaggcccacgtggcggctagtactccggtattacggtacccttgtacgcctgttttatactcccttccccgtaacttagaagcaataaatcaagttcaccaggagggggtacaaaccagtaccaccacgaacaagcacttctgtttccccggtgacgttgcatagactgtccccacggttgaaagcgactgatccgttatccgctcgtgtacttcgagaagcctagtatcatcttggaatcttcgatgcgttgcgctcagcactcgaccccggagtgtagcttaggctgatgagtctggacattcctcaccggcgacggtggtccaggctgcgttggcggcctacctgtggctcaaagccacaggacgctagttgtgaacaaggtgtgaagagcctattgagctacacgagaatcctccggcccctgaatgcggctaatcccaaccacggagcaagtgctcacaaaccagtgagtggcttgtcgtaacgggtaactctgtggcggaaccgactactttgggtgtccgtgtttcctttttatttttgtatggctgcttatggtgacaatcagagattgttatcataaagcgtattggattggccatccggtgagtgttgtgtcaggtatacaactgtttgttggaaccactgtgttagctttacttctcatttaaccaattaatcaaaaacaatacgaggataaaacaacaatactaca

SEQ ID NO: 1201 - DNA, 750 bp, Rabbit picornavirus
  strain Rabbit01/2013/HUN, complete genome.1
ttccccttcccccttttcacggcccggccgcccgccgggtcgtcacccgttcagacacctacgggttatctgttcgggctataaatatgggcattcctcttcccccttccccttttgaagatgagtgcgcatattcttgactccgcctggattggccgcccaaggcgtgaacaagcagctaggccaccatgacactgcggtggtgtccgaacccgcgggtgccttcacgggcacctgtggtatgtaggactcccaccgtggtcttccctttccccctcaatctttccccctggttcgactaacgggaccagtgctggaacctgtccggtgaacggtatagcaggcccccccggcagaaacacccggtgcttaccccttaaggctagcccccttccatgaatttggttggggcaactagtgggtgtacagttggcgtgaaccctccggtctaggagtgctcttgcccaatcctctgtgtgtgccttgcagtagggactggcaatccttcgcgtaggtgatccgctgtgccatgccatcctggcgacaggaggcccagtgtgcgcaacctacgtcccttctgggtgctgcattgcattacctttggagtaagcttggtgtgccgaaaccccagggtttacgtaccactcgtggtgtgaggaatgtgccgcaggtaccccatccttgaggtgggatctgagcggtagctaattgtctagcaccactttcttccttttttctttgctggtcacg

SEQ ID NO: 1202 - DNA, 750 bp, Coxsackievirus
  A14 gene for polyprotein, polyprotein region,strain1
ttaaaacagctctggggttgtacccactcacagggcccactgggcgctagcactctgattctacggaatccttgtgcgcctgttttataaccccctcccaatatgtaacttagaagcagcacatactaccgatcaatagtgggcatggcgcaccagccatgtctcgatcaagcacttctgtttccccggactaagtatcaatagactgctcacgcggttgaaggagaaagcgtccgttacccggctaactacttcgagaaacccagtagcaccactgaagctgcagagtgtttcgctcagcacttcccccgtgtagatcaggtcgatgagtcaccgcaatccccacgggcgaccgtggcggtggctgcgtggcggcctgcctgtggggcaacccacaggacgctctaaagtggacatggtgcgaagagtctattgagctagttagtagtcctccggcccctgaatgcggctaatcctaactgcggagcgcatgccttcaaaccagatggtagtgcgtcgtaatgggcaactctgcagcggaaccgactactttgggtgtccgtgtttccttttattcttacattggctgcttatggtgacaatcacagaattgttaccatatagctattggattggccatccggtgtgtaatagagcaataatttactcttttgttgcttttgttccattgaccttcactacactgaacactttacagtacatacttcaactcaactccagaaagcaatc

SEQ ID NO: 1203 - DNA, 750 bp, Enterovirus sp.
  A120,strain TRT/2013-23196, complete genome.1
ttaaaacagcctatgggttgcacccacccatagggcccactgggcgctagcactctgattctacggaatctttgtgtgcctgttttatagtccctccccccgacttgtaacttagaagtaatgcaaaccactggtcaatagcaggcatgacgcaccagtcatgtcttgatcaagcacttctgtccccccgggctgagtatcaatagactgctcacgcggttgaaggagaaaacgctcgttacccggctaactacttcgagaaacctagtagcaccattgaaactgcagagcgtttcgctcagcactccccccgtgtagatcaggtcgatgagtcactgcactcctcacgggcgaccgtggcagtggctgcgttggcggcctgcctatggggtaacccataggacgctttaatgtggacatggtgcgaagagtctattgagctagttagtagtcctccggcccctgaatgcggctaatcctaactgcggagcacacgcccttaatccaaggggtagtgtgtcgtaatgggcaactctgcagcggaaccgactactttgggtgtccgtgtttccttttatttttatactggctgcttatggtgacaattgagagattgttaccatatagctattggattggccatccggtgtgcaacagagctattatctacctgtttgttggatatataccactcacagctgacaaaacccttatcacattattgtacatcctacacttgaactcaagaaa

SEQ ID NO: 1204 - DNA, 750 bp, Coxsackievirus
  A24,strain K282/YN/CHN/2013, complete genome.1
ttaaaacaagctgtggggttgttcccaccccagaggcccacgtggcggctagtactccggtattgcggtacccttgtacgcctgttttatactccctgcccccgtaacttagaagcacaaagaaatcaagttcaacagcagggggtacaaaccagtaccaccacgaacaagcacttctgttcccccggtgacgtcgcatagactgtgcccacggttgaaaacgattgatccgttaaccgctcttgtacttcgagaagcctagtatcacattggaatctacgatgcgttgcgctcagcactcaaccccagagtgtagcttaggctgatgagtctggacattcctcaccggtgacggtggtccaggctgcgttggcggcctacctgtggcccagagccacaggacgctagttgtgaacaaggtgtgaagagcctattgagctacaagagagtcctccggcccctgaatgcggctaatcccaaccatggagcaggtggtcacaatccagtgattggcctgtcgtaatgcgcaagtccgtggcggaaccgactactttgggtgtccgtgtttccttttattttacacttggctgcttatggtgacaatcatagattgttgtcataaagcaaattggattggccatccggtgaaaactaaatacgctatttacctgtttgttggatttataccttcaacttacaacacttattgtattatttgcattgtgttattgattagacaacaatactaca

SEQ ID NO: 1205 - DNA, 750 bp, Human poliovirus 2
  strain NIE0711199, complete genome.1
ttaaaacagctctggggttgttcccaccccagaggcccacgtggcggccagtactccggtattacggtacccttgtacgcctgttttatactcccttcccctgtaacctagaagaagtaaattaagttcaataggagggggtacaaaccagtaccaccacgaacaagcacttctgtttccccggtgacgttgtatagactgtgtccacggtcgaaagcaattgatccgttatccgctcttgtacttcgagaagcctagtaccagcttggaatcttcgatgcgttgcgttcagcactcaatcccagagtgtagcttaggttgatgagtctggacatccctcaccggcgacggtggtccaggctgcgttggcggcctacctgtggcccaaagccacaggacgctagttgtgaacaaggtgtgaagagcctattgagctacaagagagtcctccggcccctgaatgcggctaatcccaaccacggagcaagggtgcatgaaccaatgcatgccttgtcgtaatgcgtaagtctgtggcggaaccgactactttgggtgtccgtgtttccttttatttttatattggctgcttatggtgacaatcagagattgttatcataaagcgaattggattggccatccggtgagtgttgtgtcgggtatacaactgtttgttggaaccactgtgttaactttgcttcttatttaaccaattaatcaaaaacaatacgaggataaaacaacaataccaca

SEQ ID NO: 1206 - DNA, 750 bp, Human poliovirus 2
  strain NIE0811456, complete genome.1
ttaaaacagctctggggttgttcccaccccagaggcccacgtggcggctagtactccggtattccggtacccttgtacgcctgttttatactcccctcccccgtaacttagaagaaacaaaccaagttcactaggagggggtacaaaccagtaccaccacgaacaagcacttctgtttccccggtgatattgtatagactgtacccacggtcgaaaacgattgatccgttatccgcttctgtacttcgagaagcctagtaccactttggaatcttcgatgcgttgcgctcagcactcaaccccagagtgtagcttaggtcgatgagcctggactttcctcactggcgacagtggtccaggctgcgttggcggcctacctgtggcccaaagccacaggacgctagttgtgaacaaggtgtgaagagcctattgagctacaaaagagtcctccggcccctgaatgcggctaatcccaaccatggagcaagggtgtacgaaccagtacatatcttgtcgtaacgcgcaagtccgtggcggaaccgactactttgggtgtccgtgtttccttttattttcatactggctgcttatggtgacaatcatagattgttatcataaagcgaattggattggccatccggtgagtgttgtgtcaggtatacaattgtttgttggaaccactgtgtcagctttacttctcatttaaccaattaatcaaaaacaatacgaggataaaacaacaataccaca

SEQ ID NO: 1207 - DNA, 751 bp, Ljungan virus
  genomic RNA, nearly complete genome,strain: Fuz1.1
cgcggccatgtttgtaagcatggccgtagggaccccccggtgggctgggtgcacttctcgccttttaggtgggggtgtggctcggctaccaccactgggtggcaaccagttttcatgtaatagccaaacaagtaacattaacacctaagcttctggtgcaccaccctgtctggttgaagccgcttggaataaaattggatagctaaggtggattgtcaaacatgcatttctgtctcctggatatccttaatatccaggtaagggctgtacccgggcggtcctactcttcacaggagtctgcataggtggctttcacctctggacagtgcactccctcccgctccctcacccaagttagctggaacacagaatgaaaaatgagcgaacactagaaccaggtgtagcgaccacacatatgccagcggatttcccctagtggtaacactagcctctgggcccaaaaggcacgtctttgaccatatgtgtgcacaatcccagtgatggttctatctagtagtttatttagtaattttgtgaactggctcactgaacgtgagttggaggcttaggaatggcgggctgaaggatgccctgaaggtacccgtaggtaacgataagctcactatggatctgatcaggggcccaccagcatatttgctgggtagaagtcttcggaccttgggttaaaaaacgtctaggcccgtcccccagagggatctggggtttccctaataaccccaatactgacatt

SEQ ID NO: 1208 - DNA, 752 bp, Rosavirus C
  strain RRTPC2A polyprotein gene, complete cds.1
ggttcccgcccccacctccgtcacagcctttcgaggctgtgctggaacggcgacagggagtttagacttcttgccgctatgggttcttctgccccgtgttttggacgcccggcatggcgttaaactgtcattccccctaccctttccctatttgtaactaagttgtgcctcgcccagacaggctgctaagacgcttgttgctacagcatgtttggactagcgagctctccataagtaaacttttccacccccttgggtgtctttgcccttggggacggtctggagccccgttgtcttagacagagtgtgtcggtgcaggctttctgctctggacccatgccggccacaaactcccatcagtgttgtgaagacggtaggacacaagtgaacaggtacagggaactttcttggaatgtagcgattactgcaagtgagcggacctcccctggtggtaacaccagcctctcaggccaaaagccacggtgttaacagcacccttgcagtaggccactgccccgtggtctccaggatctttctctttactcctagtaatttgtgaatctagctgttctgaagcatactggtgcaaaggctaaggatgccctgaaggtacccacaggtaacgttaagacactgtggatctgatcaggggcctgaatactgaagctttacagaggtagttcaggttaaaaaacgtctatgcctttcccccacgggagtgggggttcccccacacttttatcacaggcact

SEQ ID NO: 1209 - DNA, 753 bp, Coxsackievirus
  A14,isolate PZ05Y/JS/2012, complete genome.1
tttaaaacaagctctggggttgtacccacccacagggcccactgggcgctagcactcttattctacggaatatttgtgcgcctgttttatagccctcccccattaagtaacttagaagtgatgtgcagcacagatcaatagcaggcatagcgcaccagctgtgtcttgatcaagcactcctgtttccccggactgagtatcaataaactgctcacgcggttgaaggagaaaacgttcgttacccggctaaccacttcgagaaacttagtaacaccattgaagctgtagagtgtttcgctcagcacttccccagtgtagatcaggctgatgagtcactgcgaccctcacgggcgaccgtggcagtggctgcgttggcggcctgcctatggggcaacccataggacgctctaaagtggacatggtgtgaagagtctattgagctggttagtagtcctccggcccctgaatgcggctaatcctaactgcggagcgcatgccctcaaaccagggggtggtgcgtcgtaacgggtaactctgcagcggaaccgactactttgggtgtccgtgtttccttttattctcatattggctgcttatggtgacaattgaagaattgttaccatatagctattggattggccatccggtgtgtaacagagcgattatcttctcttttattgcctttgtcccattgaccccaactgcgttaaacactctgcaatatatactctatcttaactctaggaagcgaac

SEQ ID NO: 1210 - DNA, 753 bp, Human enterovirus sp.
  99,strain OMA99-10696 polyprotein gene, complete1
ttaaaacagcctgtgggttgttcccaccccagaggcccacgtggcggctagtactctggtattacggtacccttgtacgcctgttttatactcccttcccatgtaacttagaagcaaataacacaagttcaatagaagggggtacaaaccagtaccaccacgaacaagcacttctgttaccccggtgaagttgcatagactgttcccacggttgaaagcgaccgatccgttatccgctcaagtacttcgagaagcctagtatcaccttggaatcttcgatgcgttgcgctcatcactcaaccccagagtgtagcttgggctgatgagtctggacgtccctcactggcgacagtggtccaggctgcgttggcggcctacctatggcccaaagccataggacgctagttgtgaacaaggtgtgaagagcctattgagctacttgagagtcctccggcccctgaatgcggctaatcccaaccacggatcaggtgattgcaaaccagcaattagcctgtcgtaacgcgcaagtctgtggcggaaccgactactttgggtgtccgtgtttccttttattttactattggctgcttatggtgacaatcattgattgttatcataaagcgaattggattggccatccggtgaaagtaaaacaggttatttacctttttgttggatttactgcattatctaagcacactccagatttaattcgtatcgttcttgcgattaggagagcacacttttccagca

SEQ ID NO: 1211 - DNA, 753 bp, Enterovirus sp.
  B,isolate NL/18-111/FAE/2018 polyprotein gene, complete1
ttgatcaaggcccagttggtgcactgggttgatcccacccacagggcccactgggcgcatgcactctggtatcacggtacctttgtgcgcctgttttatctcccctcccccccgtgtaatttagaagcataagcacaatgatcaatagacaacccagtgcaccaactgggccttgatcaagcacttctgttaccccgggccgactatcaataggctgctcacgtggctgaaggagaaaacgctcgttacccggccagttacttcgagaagcctagtaccaccatgaacgttgcgcagtgtttcgctccgcacaaccccagtgtagatcaggtcgatgagtcaccgcatcccccacgggtgaccgtggcggtggctgcgttggcggcctgcccatggggtaacccatgggacgctacaatactgacatggtgtgaagagtctattgagctaactggtagtcctccggcccctgaatgcggctaatcccaactgcggagcacgtgcttccaatccaggaggtagcgtgtcgtaacgggcaactctgcagcggaaccgactactttgggtgtccgtgtttcctttatctctttattggctgcttatggtgacaattgaaagattgttgccatatagctattggattggccatccggtatctaacagagcaatcatatacctgtttgttggatttgttccacttaacaaaacagagttccgtactttgtgttatattattaggttgaacacatcaaa

SEQ ID NO: 1212 - DNA, 753 bp, Human enterovirus C
  isolate V2-TOL cl1, complete genome.1
ttaaaacagctctggggttgttcccaccccagaggcccacgtggcggccagtacaccggtatcacggtacccttgtacgcctgttttatactccctctcccctgtaacttagaagcaaataaaccaagttcaatagaaagggggtacaaaccagtaccaccacgaacaaacacttctgtttccccggtgaggttgtataaactgtccccacggttgaaaacgactgatccgttacccgctcttgtacttcgagaagcctagtatcatcttggaatcttcgatgcgttgcgctcagcactcgaccccggagtgtagcttaggctgatgagtctggacgttccccaccggcgacggtggtccaggctgcgttggcggcctacctgtggcccaaagccacaggacgctagttgtgaacagggtgtgaagagcctattgagctacaagagagtcctccggcccctgaatgcggctaatcccaaccacggagcaggtggttgcaatccagcaactagcctgtcgtaacgcgcaagtctgtggcggaaccgactactttgggtgtccgtgtttccttttattcttacaatggctgcttatggtgacaatcatagattgttgtcataaagcgaattggattggccatccggtgaaagtcagatcaactatttatttgtttgttggagccactgtgttagctttacttctcatctaaccaattaatcaaaaacaatacgaggataaaacaacaacactaca

SEQ ID NO: 1213 - DNA, 753 bp, Enterovirus sp.
  D94,strain ANG/2010-23293, complete genome.1
ttaaaacagctctggggttgttcccaccccagaggcccacgtggcggctagtactccggtattacggtacccttgtacgcctgttttatactcccttcccccgtaacttagaagtaacacaaatccaagttcaatagaagggggtacaaaccagtaccaccatgaacaagcacttctgtttccccggtgaaatcatagactgtacccacggttgaaagtgatcgatccgtcatccgctcttgtacttcgagaagcctagtatcaccttggaatcttcgatgcgttgcgctcaacactcaaccccagagtgtagcttaggctgatgagtctggacactccccaccggcgacggtggtccaggctgcgttggcggcctacctgtggtccaaagccacaggacgctagttgtgaacaaggtgtgaagagcctattgagctacaggagagtcctccggcccctgaatgcggctaatcccaaccacggagcaggtggtcataatccaatgattggcctgtcgtaacgcgcaagtctgtggcggaaccgactactttgggtgtccgtgtttccttttattttatcattggctgcttatggtgacaatctaagattgccatcatatagcttttggattggccatccggtgatacttcgagttatttagcttgctgcttacatttattttaaacaacatccagttaccagcattcctattttgtttttctttcattctgagttatctaataagtagttaga

SEQ ID NO: 1214 - DNA, 754 bp, Coxsackievirus
  A10,strain 11-1415-1, complete genome.1
gagttcagacgtgtgccttccgatgtgggttgcacccacccacagggcccactgggcgctagcactctgataccacggtacctttgtgcgcctgttttatcaccctaccccacacgaaacttagaagcaatacataactgaccaatagtaggtgtggcgcaccagccacatcttggtcaagcacttctgtctccccgggttgagtatcaataagctgttcacacggctgaaggagaaaacacccgttacccggccaactacttcgagaaacctagtatcaccatgaacgttgcgaggtgtttcgctcagcacttcccccgtgtagatcaggccgatgagtcaccgcattccccacgggtgaccgtggcggtggctgcgttggcggcctgcctatgggttagcccataggacgccttaatactgacatggtgcgaagagtctattgagctagttggtagtcctccggcccctgaatgcggctaatcctaactgcggagcacatacccacaaaccagtgggcggtgtgtcgtaacgggtaactctgcagcggaaccgactactttgggtgtccgtgtttccttttatctttatattggctgcttatggtgacaatcagagaattgttaccatatagctactggattggccatccggtgtccaatagagctattatatacctgtttgttggattcaccccattgacctacaaatccctaaatactttgtgttatattttgaacttaaatacacgaaa

SEQ ID NO: 1215 - DNA, 754 bp, Enterovirus sp.
  C99,isolate YT31/SD/CHN/11, complete genome.1
ttaaaacagcctgtgggttgttcccaccccagaggcccacgtggcggctagtactccggtattacggtacccttgtacgcctgttttatatccccttcccctgtaacttagaagcagacaacacaagttcaatagaagggggtacaaaccagtaccaccacgaacaagcacttctgttaccccggtgacgttgcatagactgttcccacggtcaaaagcgatcgatccgttatccgctcaagtacttcgaaaagcctagtatcaccttggaatcttcgatgcgttgcgctcggcactcgatcccggagtgtagcttaggccgatgagtctggacgatcctcactggcgacagtggtccaggctgcgttggcggcctacctatggcccaaagccataggacgctagttgtgaacaaggtgtgaagagcctattgagctacttgagaatcctccggcccctgaatgcggctaatcccaaccacggatcaggtgattgcaatccagcaattggcctgtcgtaacgcgcaagtctgtggcggaaccgactactttgggtgtccgtgtttccttttaattttattgctggctgcttatggtgacaatcgtagattgttatcatagagcgaattggattggccatccggtgagattaaaacacattatttacctttttgttggatttaccacactatctacgtacactccagacttaatccgcatagtacttttaattagaagatcttatcattataaca

SEQ ID NO: 1216 - DNA, 754 bp, Human enterovirus sp.
  C99,isolate HT-XEBGH09F/XJ/CHN/2011, complete1
ttaaaacagctctggggttgttcccaccccagaggcccacgtggcggctagtactccggtatcgaggtacccttgtacgcctgttttatactcccttcccccgtaacttagaagccaaaaatacaagttcaatagaagggggtacaaaccagtaccaccacgaacaagcacttctgttaccccggtgatgttgcatagactgtccccacggtcgaaagcgattgatccgttatccgcttaggtacttcgagaagcctagtatcaccttggaatcttcgatgcgttgcgctcatcactcgaccccggagtgtagcttaggtcgatgagtctggacgatcctcactggcgacagtggtccaggctgcgttggcggcctacctatggcccaaagccataggacgctagttgtgaacaaggtgtgaagagcctattgagctacttaagagtcctccggcccctgaatgcggctaatcccaaccacggatcaggtgattgcaatccagcgattggcctgtcgtaacgcgcaagtctgtggcggaaccgactactttgggtgtccgtgtttccttttaattttattattggctgcttatggtgacaatcatagattgttatcataaagcgaattggattggccatccggtgaaaataaaacacattatctacctttttgttggatttactacactgtctacacacactccagatataatttatatagttcttttaatcaggagatcttatcattataaca

SEQ ID NO: 1217 - DNA, 754 bp, Human poliovirus 1
  strain ETH1319533, complete genome.1
tggggacaaagttaacagctctggggttgttcccaccccagaggcctacgtggcggctagtactccggtattacggtacccttgtacgcctgttttatactccccaccccgcaacttagaagaagctaatcaagttcaataggagggggtacaaaccagtaccaccacgaacaagcacttctgtctccccggtgacattgcatagactgtccccacggttgaaagcgatcgatccgttatccgctcttgtacttcgagaagcctagtaccatcttggaatcagcgatgcgttgcgctccgcactcaatcccagagtgtagcttaggctgatgagtctggacattcctcaccggcgacggtggtccaggctgcgttggcggcctacctgtggcccaaagccacaggacgctagttgtgaacaaggtgtgaagagcctattgagctataagagagtcctccggcccctgaatgcggctaatcccaaccacggatcaagggtgcacgaaccagtgtataccttgtcgtaacgcgcaagtctgtggcggaaccgactactttgggtgtccgtgtttccttttattgtttcaatggctgcttatggtgacaatcattgattgttatcataaagcgaattggattggccatccggtgaaagtgaaacatattgtttgcctccttattgggtctactccaatcgacctctttacctacaatcttattgccacagttttactggttagaagtgtgtttcaca

SEQ ID NO: 1218 - DNA, 755 bp, Bovine kobuvirus
  strain BKoV/EGY-1, complete genome.1
cgcacgttcgcgtcgtcgtaagtctggattcccaaggccaacttggtttaacttcggtttctggacaaatacaaagaacctcagtcctcttggtactttctcgcctgagtcaacaaagcgagaaacctgcccctctaacgccagacgagcggcataaaacttgaacttctggcacgctccactcttccctctcccaatcccatccccatcgcgctctcaaggtcgcgcaattctgggactagcccagatttaaaagttcctggcaccctttgcccctttaggcccttaaggcaggaactgaccttgtgctgtgacctcggtgcggaagtgctactgcgtagtgattgtaagctcctcttatggttctgccctggcaaggctatagagtactgtgatccgctgcggatgccatcctggtaacaggacccccagtgtgcgtaacagtatgttcacggctcaccgtgttcaccatgactggaacactgctttcgtgaaacagtgtgtgtccaatccctgtgatcagtatcaaccacaccacctaggaatgctaggaaggtaccccggttcgccgggatctgatcctaggctaattgtctacagtggtgctcctttattttctctccaaccatttattgttcacaactgcttgatcttgtgtttgctgcctttctctgctctcactgccattctcaagtgttcacactgtccaagctcctttggttgttttcatccacttgccattgtcaactcttgtc

SEQ ID NO: 1219 - DNA, 755 bp, Unknown
  Description of Unknown: Human coxsackievirus A14, strain G-14, complete genome.1 sequence
ttaaaacagcctgtgggttgtacccacccacagggcccactgggcgctagcacactgattctgcgggatctttgtgcgcctgttttatatcccctccccccaaactaggtaacttagaagattagcacttgtatgaccaatagtaggcgtgacgcgccagtcatgtcttggtcaagcacttctgtttccccggactgagtatcaataagctgcttgcgcggctgaaggagaaaacgttcgttacccggctaactacttcgagaaacctagtaacaccatgaaagttgcggagtgtttcgctcagcacttcccccgtgtagatcaggtcgatgagtcactgcaaaccccacgggtgaccgtggcagtggctgcgttggcggcctgcctatgggtcaacccataggacgctctaatacagacatggtgtgaagagtctattgagctagttagtagtcctccggcccctgaatgcggctaatcctaactgcggagcacacgcttgcaaaccagtgagtagtgtgtcgtaatgggcaactctgcagcggaaccgactactttgggtgtccgtgtttccttttattctcatactggctgcttatggtgacaattgaagaattgttactatatagctattggattggccatccggtgtgtaacagagcgataatctactcctttgttgcatttgttccactaacccttactacattagacattctacaatacatactttatctcaactccaagaaacgaac

SEQ ID NO: 1220 - DNA, 758 bp, Coxsackievirus
  A10,strain 11-691-1, complete genome.1
aacacataaccgaccaataaaacagcctgtgggttgcacccacccacagggcccattgggcgctagcactctggtaccacggtacctttgtgcgcctgttttatcaccctaacccccacgaaacttagaagtaacacataaccgaccaatagtaggtgtggcgcaccagccgcatcttggtcaagcacttctgtttccccgggttgagtatcaataagctgttcacacggctgaaggagaaaacacccgttacccgaccaactacttcgagaaacctagtaccaccatgaacgttgcaaggcgtttcgctcagcacttcccccgtgtagatcaggccgatgagtcaccgcattccccacgggtgaccgtggcggtggctgcgttggcggcctgcctatgggttagcccataggacgccttaatactgacatggtgcgaagagtctattgagctagttggtagtcctccggcccctgaatgcggataatcctaactgcggagcacatactcacaaaccagtgagctgtgtgtcgtaacgggcaactctgcagcggaaccgactactttgggagaccgtgtttccttttatctttatattggctgcttatggtgacaatcagagaattgttgccatatagctattggattggccatccggtgtctaatagagctattatatacctgtttgttggattcactccgctgacacataaatcccttaatactttgtgttatatcttgaacttaaacacacgaaa

SEQ ID NO: 1221 - DNA, 758 bp, Enterovirus sp.
  B93,isolate 99167/XZ/CHN/1999, complete genome.1
tacaaaaaagcaggctttaaaacagctctggggttgttcccacccacagggcccactgggcgctagcactctggtatcacggtacctttgtgcgcctgtttttccacccctccccatacgcaacttagaagagagactcaaccggtcaatagacagcctagtacaccaactaggttctgaccaagaacttctgtttccccggaccgagtatcaataggctgcttacgcggctgaaggagaaaacgttcgttacccggccaattacttcgagaaacctagtatcaccatggaagttgcgcagtgtttcgctccgcacaaccccagtgtagatcaggtcgatgagtcaccgcattccccacaggcgactgtggcggtggctgcgttggcggcctgcccgtggggcaacccacgggacgcttcaataccgacatggtgcgaagagtctattgagctaattggtagtcctccggcccctgaatgcggctaatcctaactgtggagcagatacccacgcgccagtgggcagtctgtcgtaatgggcaactccgcagcggaaccgactactttgggtgtccgtgtttccttttatcctcataatggctgcttatggtgacaattgaaagattgttgccatatagctattggattggccatccggtgactaacagagcaattatttacttgtttgttgggtttgtaccattgaactacaaggtccttaatactctaaactacattataagtctcaatacagtgca

SEQ ID NO: 1222 - DNA, 759 bp, Cosavirus JMY-2014
  isolate Cosa-CHN, complete genome.1
acatgggggagactgcatgtggcagtcttgaaacgtgtggtttgacgtctaccttatatggcagtgggtggagtactgcaaagatgtcaccgtgctttacacggtttttgaaccccacaccggctgtttgacgctcgtagggcagcaggtttattttcattaaaattcttactttctagctgcatgagttctattcatgcagacggagtgatactcccgttccttcttggacaggttgcctccacgccctttgtggatcttaaggtgaccaagtcactggtgttggaggtgaagatagagagtcctcttgggaatgtcatgtggctgtgccaggggttgtagcgatgccattcgtgtgtgcggatttcctctcgtggtgacacgagcctcacaggccaaaagccccgtccgaaaggacccgaatggtggagtgaccctgactcccccctgcatagttttgtgattaggaacttgaggaatttctgtcataaatctctatcacatcaggccccaaagatgtcctgaaggtaccctgtgtatctgaggatgagcaccaccgactacccggacttgcattagcagacacatgtggttgcccagccccacctcttcagaggtggggctttgctcactcagcacaggatctgatcaggagccccgctcgtgtgctttacactcgacgcggggttaaaaattgcccaaggcctggcacaacaacctaggggactaggttttcctatttttgtaaattatgtcaat

SEQ ID NO: 1223 - DNA, 759 bp, Coxsackievirus
  A16,strain S0470B polyprotein gene, complete cds.1
attggctcgagttacttaaaacagcctgtgggttgtacccacccacagggcccactgggcgctagcacactggttctgcgggacctttgtgcgcctgttttataacccttccctaagcagtaacttagaagctttgtacaatcatggccaatagtgggcgtggcgcgccagtcacgtcttggtcaagcacttctgtatccccggactgagtatcaatagactgctcacgtggttgaaggagaaaacgtccgttacccggctaactacttcgagaaacctagtagcaccatgaaagttgcggagtgtttcgttcagcacttcccccgtgtagatcaggtcgatgagtcactgtaaaccccacgggcgaccgtgacagtggctgcgttggcggcctgcccatggggtaacccatgggacgctctaatacagacatggtgcgaagagtctattgagctagttagcagtcctccggcccctgaatgcggctaatcctaactgcggagcgcgcaccctcaacccagggggcggcgcgtcgtaatgggcaactctgcagcggaaccgactactttgggtgtccgtgtttccttttattctttattggctgcttatggtgacaattgaaaagttgttaccatatagctattggattggccatccggtgtctaacagagctattgtttacctattcattggattcgtccctcttaatctcaaggtcattcaaactctcgattgcatattgctccttaactgtaagaa

SEQ ID NO: 1224 - DNA, 761 bp, Gallivirus A1
  strain turkey/M176/2011/HUN, complete genome.1
tccctacccaagccccagtacaccactatggagttctttatatcccagcgcgtggtggacgcactgtgaggtattccgataccaccccactcgcacttcctggatagtgcgttagatatgcccgacatatcgcttccaggaccaaagccccccttttctctttcccaaccagcttcgccactcaagctgtaattccatgtccggtctttccggccttagtatcatggaaatgtggtcgtgctcaaatgaaattgagttgacattgatcaatgaaagttgcactgaactttgctaaactggctagcgccacctggtgtgtgccgttggtctcctcacatggtaacatgtgccaacgggcccgaaaggctagtgggcaattaccgctccaagggaggggtacccaccccgacctgaacagcggtaatgaagctcacctcccaggctctgaccccgagaagtttagttatttagtaggtgtaattagtacttgtgattggtcaatttgatagtagtttgaaacgttatggatgaatgagtagaccccctgaaggtaccccattacatgggatctgatcagggccacattctgcgtgtctccccgcacttgtggttaaaaccatgaaagttcatcccaaacaatcttttcctcttctttttcttttagtggtgacaacctactggattggtgattaccaatctgtactagtgttgtattaagacttgttgtgtggagaaaatggactctttcaagaagatttttg

SEQ ID NO: 1225 - DNA, 762 bp, Ljungan virus
  strain 87-012G, complete genome.1
ttgaaaggggggccctgtggccaattttggccacagggttcccctggtggggtgggtacacttctcgctcgatgagtgggggtgtggctcattgcccacacctggttggttcccaggttcatacaataaccatcaataaacttttaacatctaagatagtattatcccatactagactggacgaagccgcttggaataagtctagtcttatcttgtatgtgtcctgcactgaacttgtttctgtctctggagtgctttacacttcagtaggggctgtacccgggcggtcccactcttcacaggaatctgcacaggtggctttcacctctggacagtgcattccacacccgctccacggtagaagatgatgtgtgtctttgcttgtgaaaagcttgtgaaaatcgtgtgtaggcgtagcggctacttgagtgccagcggattacccctagtggtaacactagcctctgggcccaaaaggcatgtcatttgaccactcaggtacacaaccccagtgatgcacacgcttagtaatggcttagtaacaaacattgattgatcatttgaaagctgttaggaggtttaggtatgacgggctgaaggatgccctgaaggtacccataggtaaccttaagcgactatggatctgatcaggggcccaccatgtaacacatgggtagaagtcttcggaccttgggttaaaaaacgtctaggcccgccccccacagggatgtggggtttcccttataaccccaatattgtata

SEQ ID NO: 1226 - DNA, 762 bp, Coxsackievirus
  A16,isolate ZJ10-48 polyprotein gene, complete cds.1
tacaaaaaagcaggctttaaaacagcctgtgggttgttcccacccacagggcccactgggcgctagcacactgattctgcgggatctttgtgcgcctgttttataacccctcccctaagcagtaacttagaagcttcacactattacgaccaatagtaggcgtggcgcgccagtcacgttttggtcaagcacttctgtctccccggactgagtatcaatagactgctcacgcggttgaaggagaaaacgttcgttatccggctaactacttcgagaaacctagtagcaccgtgaaagttgcggagtgtttcgctcagcacttcccccgtgtagatcaggtcgatgagtcactgtgaaccccacgggtgaccgtgacagtggctgcgttggcggcctgcccatggggtgacccatgggacgctctaatacagacacggtgtgaagagtctattgagctagttagtagtcctccggcccctgaatgcggctaatcctaactgcggagcgcgcaccctcaatccagggggccagcgcgtcgtaatgggtaactctgcagcggaaccgactactttgggtgtccgtgtttccttttattccttattggctgcttatggtgacaattgaaaagttgttaccatatagctattggattggccatccggtgaccaacagagctattgtttacctgtttattggatacgtccctctcaatctcaaagccattcaaactcttgattacatattacttcttaactgtaagaa

SEQ ID NO: 1227 - DNA, 766 bp, Kobuvirus SZAL6-KoV/2011/HUN
  complete genome.1
tttcacaccctcttttccggtggtccggacccagaccaccgttactccattcagctacttcggtacctgttcggaggaattaaacgggcaccctacccaagggttacatgggaccatattcctcctcccctgtaactttaagttttgtgcccgtattcttgactccaggcggatgttgtgtcgcccgtcctgtgaacaaacagctagacactttcctcccctccctctgggctgctccggcagtccactccctccccccagcgtaacatgccccgctggagtgatgcacctggaagtcgtggacgtgggttagtaacttcggtgaaaacccactataatgacaactggttgacccccacactcaaaggactcgagtctttctcccttaaggctagcccggccacatgaatttgcagctggcaactagtgagtccaccatgtcccgcaacctcggctgcggagtgctgttccccaagcgtatgccttccttctgtaagagtgcgcctggcaagcacatctgagaagtcgttccgctgcgtcgtgccaacctggcgacaggtgacccagtgtgcgtagacttcttccggattcgtccggctcttctctaggaaacatgcgtgtaaggttcatgtgccaaagccctgcgcgcggtgttcttctactgccctaggaatgtgccgcaggtacccctacttcggtagggatctgagcggtagctaattgtctacgggtagtttcatttccatcttctcttcaggtcgacatc

SEQ ID NO: 1228 - DNA, 768 bp, Antarctic picorna-like virus 4
  nonstructural protein and structural1
tatttgtttatttatcacaataagcattacatgagtttgtttaataacatactctgcaaatttattgtaggtgtttagagattaaaccaatctcttttcatttacaaaaccaataagtttgtaaaatagtaaaatttttagccattctgattcaggaatcaaaactgatgtaccactatctgtattttgtgaaaaatcaaaacgacagtagactagaaattactttgtatctaggaatctgtgtctaacgacgatagttaggaacgtgttgcacatttcatgtgcaggcctttatcactaggtctttattaaaaaagtggttgcaagttgtaattgacaacatgtgtttagttaagtttacttctattcatgattatcagggatctccttatcccgctattattagcaaaaggagccttgcaggttataccgacctgcatatgaagcctctacattaatttgtaatttttgtaggaaactgagagggaaagtggcataaccctcgtcctcgcggcgtataatgattcttcggaagaatacgacgtaacccagccgtcacaggtgcccattctctgggattgcatgcttgcatgtcgttctaggatttttcaggaacatttttgagctatagtagtttagatacgctatttgcaatgatgaaactacctagggtgggattatgagaaattcaactttgatctatttttcacaataggttgaggttggattttctcgtatttgggtttggggggtatactatttcaaatc

SEQ ID NO: 1229 - DNA, 769 bp, Gallivirus Pf-CHK1/GV
  complete genome.1
ttgaccccggtatttctccgtctaaattagacggttcttttatatcccagtgcctgaagctggcactgtgaggttagtctactaaccaaggcttccgtgcagggcttgcacgttaggagttcatgttgattcatgctccaatgcccaaaactttgtgtgtttgtctgtgtctttcccaaagttcttcctaaggtttcggtactcaagccttaatctctggtcccagcttttgggccttagtatccagagaatgtacccgtgcttcgatgaacgtaagaaagctgtcttttaccgaaaaattttaatgaaataagtataactggctcgcgccacctggtgtgtgccgttggaattcccccatggtaacatggtccaacgggcccgaaaggctagtgggcaatcggtcctccaaggaaggggttcccaccccgacctgaacaggattcgatgaagctcacctcccaggctcctaaccccaaggaagtttacttaaagtaattaagatctagtacgtaattgctggcaattttgctagtagttgggaacgttatgacctaatgagtagacccccagaaggtaccccattttatgggatctgatctgggccctatactgtgtgtctccccacatatagggttaaaacaatgaaagttaggtccaaaatattcttttctttttattctttctttagtggtgacgccattatatcagcaatttgctgatgttttatagcgtacgcggcgatacgaacgattcatcactagagaaa

SEQ ID NO: 1230 - DNA, 770 bp, Bovine kobuvirus
  strain IL35164, complete genome.1
cacccacttttccggcggcgcacgttcgcgtcgtcgtaagtctggactcccaaggccaactcggttcaacttcggtttccggacaaatacaagaacctcagtcctcttggtactttctcgcctgagtcaacaaagcgagaaacctgcccctctaacgccagacgagcggcatgaaacttgaacttctggcatgttccactttccctctccctcaccccaccccaccgcgctctcaaggtcgcgctcttccgggactagcccggttttaaaagttcctggcaccctttgcccctctaggcccttaaggtaggaactgaccttgtgctgtgatctcggtgcggaagtgctactgcgtagtgattgtaagatccctttgtggttctgccctggcaaggctacagagtactgtgatccgctgcggacgccatcctggtaacaggacccccagtgtgcgcaacagtatgtccacggtcttccgtgttcaccacattcggaacactgctctcgtgaaacagtgtgtgtccaatccctgtgaccagtattaaccacaccacctaggaatgctaggaaggtaccccggttcgccgggatctgatcctaggctaattgtctacagtggtgctccttttattttcccctcacttcattgactacaactgcttgatttccgtgtttgctgctcttcttagctctcactgccattctcaagtgttcacactgtccaagctcctttggttgtttgcctccacttgccactgtcaactcttgtc

SEQ ID NO: 1231 - DNA, 770 bp, Coxsackievirus
  A10,strain 15-2711-1, complete genome.1
cacgtgagtgttgctcttacgtgtgctattccattctgtgggttgttcccacccacagggcccactgggcgccagcactctgattccacggaatctttgtgcgcctgttttataacccttccccaacttgtaacgtagaagtaatacacactacagatcaatagtaggcatggcgcgccagtcatgtctcgatcaagcacttctgtttccccgggctgagtatcaatagactgctcacgcggttgaaggagaaaacgtccgttacccggctaactacttcgagaaacctagtagcaccatagaagctgcagagtgtttcgctcagcacttcccccgtgtagatcaggctgatgagtcactgcaacccccacgggcgaccgtggcagtggctgcgctggcggcctgcctatggggcaacccataggacgctctaatgtggacatggtgcgaagagtctattgagctagttagtagtcctccggcccctgaatgcggctaatcctaactgcggagcacatgcctccaatccaggaggtggtgtgtcgtaacgggtaactctgcagcggaaccgactactttgggtgtccgtgtttctttttatctttatattggctgcttatggtgacaatcacggaattgttgccatatagctattggattggccatccggtgtctaatagagctattgtgtacctatttgttggatttactccactgtcatataaatctttgaacactttgtgctttatattgaacttaaacacacgaaa

SEQ ID NO: 1232 - DNA, 773 bp, Sapelovirus B
  Cam13 genomic RNA, complete genome.1
gtggggtacatgcgttttaaggaacgcatgtatctcacactcatttctccccctcgcccccacaggcaacccccaccccttctcttacgggagttagggttaaggatctagtggtcaggcgttgtatcctcttacctttacccaccccacccacacggactggttaatggttttagactgaggttgtggatctgatttcaaatctgttacccattcagaggaaaaatggagtcatacattctggatttgacttgatatgaccaagagttaacaccttgcgtgttggccgtatggaatgttttaaggctactctatggattatgatttcagggttggccgcccaggataaaaggcaattgtggtaagtgatgttagtcattggtagttgaaagctgcccaagacatccgaggtctacgctttgcgggccggagtaagcttgggaacaacagtgagtatgctattttttgctttcacccaacacgaccgtgcatgaaagagctagaggcatctggaggcaaagggaaaagaatttcttatcccgaatgttcattcgagtccttgacgagtgcatccctactgtcccgtaggtgaggtgtatggcgcatgctcatggcattactccaaggtgtatctgtgaggggggggcccctcacacttagtctagtgctacctgacagggttgcggctggtcatttatgcatggtataaccagtagtaatcccccatggattgctttaactccccctccccccttacaaagacattctctaag

SEQ ID NO: 1233 - DNA, 773 bp, Enterovirus E
  isolate PD2017, complete genome.1
ggcgtcagtacactggtacgtcagtacctttgtacgcctgtttttccctcccttaaataaattaagatcaccactactgaggggagtagtccgactccgctccggtaccgccgcaccagtattccggtacgcctagtaccctaatacggagtagatggtgtccctcacccgaaacttagaagaaagtaaactacccgaccaataggagcgcggcatccagtcgcgtatcggtcaagcacttctgtttccccggtctgcatagatcgttacccgcccgacccactgcgagaagcctagtagctggccaagcgaatgcgaggttgcgctcaaccacaaccccagtggtagctctggaagatggggctcgcaaactcccccgtggtaacacggttgcttgcccgcgcgtgcttccgggttcggtctcacgccgttcacctcaacctcgcgtaaccagtcaagagcttattgcgctggggcggttctcctccggggccgtgaatgctgctaatcctaacctctgagcgtgtgcgcacaaaccagtgttgctacgtcgtaatgcgcaagttggaggcggaacagactactttcggtaccccgtgtttcctttaattttatatttcaatttatggtgacattgactgacatttgccaagttgctcggttacctctgaacattgctttgtattatctgatagctttctacaaaaccacccagctttcacttgaactcattgagtttgtagtttatttgaaccaagcacacaaattctacg

SEQ ID NO: 1234 - DNA, 774 bp, Enterovirus G
  isolate 990/UK-NI, complete genome.1
tattttccaggtggaatggggatgcaggcctgagttgtttttgcccccaaggaataaatcaatattcccagagccgaggggagtagtccgactccgctccactacggtgctccagtagattgctattgcggtagctctctacggggtggctggtattcctcaccctgaaacttagaagtttgtacacaccgaccaatagcggtctggcagccagccaggcaacggtcaagcacttctgtttccccggtccgcaaggatcgttacccgcccgaattgctacgaaaagcctagtaagtacccaagtttgtgcgaggttgcgttcagccacaatcccagtggtagctctgagtgatggggctcgtgattacccctctggtgacagagacacttgcccgcgcgtgcacttgggttcaccagaaatggtgttcacctcaatcaagcgcaagtactgaagagccaattgtgccaatttggtctcctccggggccgtgaatgctgctaatcctaacctccgagcgtgtgcgcacaatccagtgttgctacgtcgtaacgcgtaagttggaggcggaacagactactttcggtaccccgtgtttccttattttattcatttaaatttatggtgacaattgttgagatttgtgagctagcaaaattaccattgaatttggcattgtactgtctcattgcttttcacaaaacctcagatatcccacccagttacattgatcttttagttcatttgaatttacagttcaaactgagacaagtaaa

SEQ ID NO: 1235 - DNA, 775 bp, Shrew hepatovirus
  isolate KS121289Sorara2012 polyprotein gene,1
ttgaaaggtggccggagggtttcttgaagccctccgacgcctttcagcgcccggttcacaggggtgtaagtactgtgggcccgtttgccgtgggatacggctgcctgtgtctcaggggtaagtactggggccgtgttaaccgtgcgttacggttttgcttttagattaggatgtccgactgtccggcactctcttttgcttaaaatggccttaaatccatgggaggcgtaaccatgggccctttgttacctagacatgattgcattgggggccgtccttggggcttcggccccagccaatttcccttgactcgtctaagagtttgtttcatccttttcttttcttttattttccaggctctcggcatgccaacggctctgaccactgcgcccggtggggttaaccacacgactagcgtgtggctgtaggagttaaaagtgccgacaggccaattctgacgtaagttcattctatgttaacttgaccacgtaaggttgactgatctttgtgagagggtaggctacgggtgaaaccctctaggttaatactcatattgagagatacctccagaaggtgaaggttggcggatattggtgagttcttttaggacaaaaacctttcaacgcctgtgggcccacctcactggcacaatgctttcatccccaattgtgatgggtagtttggactgaaatcaggagtaacctgccctacgagtttaggggtagttcaggggtatttaggcttccacatttgatagagtttatgagagtgagcc

SEQ ID NO: 1236 - DNA, 775 bp, Coxsackievirus
  A4,isolate 06/Taian/SD/2017, complete genome.1
tttcaaaagaatattaggaggggggggttttaaaacagcctgtgggttgtacccactcacagggcccactgggtgctagcactctgattctgcggaacctttgtgcgcctgttttaaaacccccccctcaattcgtgatttagaagtaatgcacaccattgatcaacagcaagcgtggcgcaccagccatgttcagatcaaacacttctgtttccccgggctgagtatcaatagactgctcgcgcggttgaaggagaaaacgctcgttacccggctaactacttcgagaaacctagtagcaccattgaaactacagagtgtttcgctcagcactttccccgtgtagatcaggtcgatgagtcactgcaatccccacgggcgaccgtggcagtggctgcgttggcggcctgcctatgggcttgcccataggacgctctaaagtggacatggtgtgaagagtctattgagctagttagtagtcctccggcccctgaatgcggctaatcctaactgcggagcgcatgccctcaatccagggggtggtgcgtcgtaacgggcaactctgcagcggaaccgactactttgggtgaccgtgtttccttttattcttatattggctgcttatggtgacaattgagagattgttaccatatagctattggattggccatccagtgtctaacagagcaatcgtatacttatttgttggattcatcccactatcatacatatccattaacaccttatactatattataagattgaacacaagaaa

SEQ ID NO: 1237 - DNA, 776 bp, Hedgehog dicipivirus
  strain hedgehog/H14/2015/HUN, complete genome.1
agaaaaggccccccggggggataccgtctatggtatctctacgaggtcttttcgaacactccacatcatgagtgtataataaactgatgacctttaaatttcaccaacccttgacctgtaatgtcagtggacagagtgctcctctgttcccggttaccgtgttccaggacacgattgtaatcctgcgcctcaccagcgctgcgtgcacgtctgcataaggaaacgtgccttccccatgtctctatcaattctttggtgagtgaccgccctagttgctcatcctatgggattcttctctcatgggttctttgtggcatgcgaatgtcaccttaattggaggtctttaattagatatcctttcttcatctttgatatgagtgtcggaatttgattcctagtctctgcaaaacaaccccacttgatgaattcaacttttcaaccgcacaaacataatcaggtttttaaattgaatgtttctaaattctaaatttagtttatttaagtagtttgccatcttgactcgatgtaaaattgtcatacaagtcttcttttcttttctttacactttgaagtttgcacttagcagtcgttctgcacagctttcgagttttgtttgatcgacatcgcaacttccacccacctctctttttctagtgttgaatgcggctaatcctaacccgagagcaataaacccaggtttattgtcgtaacgcgcaagtcttggacggaaccgactatacacacacctctttaccctttagtacacccttggtacg

SEQ ID NO: 1238 - DNA, 776 bp, Pigeon picornavirus B
  strain GAL-7/2010/Hungary, complete genome.1
tgaaatggcctgggggtagcatgtacgctaaggcgtgcatgttactcccagaccatttctccccaccccctcaccttgccttttccccctcatttaatttttgtcgtaagtggcatcgacaaccacacaatttaaggagaggggcagccgtggaaactaaaagaccctaattggtatcttaatgtgctaaagccttgttctgaagaggggttccccaggccccatagtaggatcttggtgttccacattaagctctaccgaccacacatccaaacgataggcggtgtaagggctctctagctaagtgtttactcattgctagggaagtgttgcgacccgttatcaatagggatacaggaggtcttagttgcctaaccagataaagtggtgctgaaatattgcaagctcaatgtctggcgaacgacggactaccgttgaactgttgttaacgcccatatgtgtaggcaacatatgggttagtaggtcacttacattgacatccgtgccgggaaagcggatctgagctatcgattgcctgatagggtgccggcgggcgcggtacgtgtggtatagtccgctgttttggggtatggcgtctactcggttttgttgtcgtttcggaatgtcccatgtcggagatgtcgttaccggtgtttgttttacttgtgcacggataaggaagcaaagtttggagttctggaagctaatggataacattaagtttccgttgcgttcttcgtgcattttgggccagaaaatcgaccacaaaatcgaga

SEQ ID NO: 1239 - DNA, 779 bp, Antarctic picorna-like virus 1
  nonstructural protein and structural1
aataaggtatgctgtttatttattaaacagtgtatcttattttgccctcatcgagagttggaggttaactaacatcctttgccacatggagtctctgtggttggttccctggccatgtatttttacaaaacagatgtgccctttgcagcttatgcaattttcggttgtttccccttttgttcgcaagattgtctcttcatttgagattttgacgttttcactcgtagtactatatgagagtgatttattacattttattttgttagcaagattggtttagttccgtcttttcttagcggagttgcacacttttctttattgctaattgcattcaccctttactggtttttcctactagttcagatcattgcaatttgttaatttccttgtctgtttggcgacccccttagtagagaggttatgatgcatcaagtgaattatgaaacagggtgtctatttaagcatttgttcttaattacgttttctttgaaaaccatttcggtggtttggcttgaattggtccctagtcacgtagttggaatgtattaagtttatttatagtcccagtgttcacggtgtttttgatcctttttgaacgggattgtacccgttcagataattcagaatttagcaaagggatttgtaatttgttccctttattggttttacaccgagacaactaccggtgacctggacatcgacaacacatcctaggggaatggcatcaccttacgagccaccacaactaaaacacaaatatacattacaatttaattatt

SEQ ID NO: 1240 - DNA, 787 bp, Coxsackievirus
  A10,strain 13-2185-1, complete genome.1
gtcaacacggtgttgtcggtattgtgtctaccggtggtaatgggcttgttggcttcgcagtgttcccacccacagggcccactgggcgccagcactctgattccacggaatctttgtgtgcctgttttacaaccctttcctaatttgtaacgtagaagcaatatacactactgatcaatagcaggcatggcgcgccagtcatgtctcgatcaagcacttctgtttccccggactgagtatcaatagactgctcacgcggttgaaggagaaaacgttcgttatccggctaactacttcgagaaacctagtagcaccatagaagctgcagagtgtttcgctcagcacttcccccgtgtagatcaggctgatgagtcactgcaatccccacgggcgaccgtggcagtggctgcgctggcggcctgcctatggggcaacccataggacgctctaatgtggacatggtgcgaagagtctattgagctagttagtagtcctccggcccctgaatgcggctaatcttaactgcggagcacatgccttcaacccaggaggtggtgtgtcgtaacgggcaactctgcagcggaaccgactactttgggtgtccgtgtttctctttatccttatattggctgcttatggtgacaattacggaattgttaccatatagctattggattggccatccggtgtctaatagagctattgtgtacctatttgttggatttactccgctatcatataaatctctgaacactttgtgctttatattgaacttaaacacacgaaa

SEQ ID NO: 1241 - DNA, 797 bp, Kobuvirus sheep/TB3/HUN/2009
  complete genome.1
tttgaaaagggggtgggggggcttcggccccctcaccctcttttccggcggcgcaagttcgcgtcgtcgtaagcctggacacccatgttcgcatcggtctccgggcaaatacaagaaccccagaccttctggtacttcttcgcctgggtcacaaaagcgaagaacctgcctctctaacgccagacgagcggcattaaacttgaacttctggcactctccactctcccttttccctgtccctttccccactgcgctctcaaggtcgcgcaatcctgggactagcccagttttaaaagttcctggcaccctttgcccctctaggcccttaaggtaggaactgaccttgtgctgtgatctcggtgcgggagtgctaccacgtagtcatcgtaagcctcgtttctggttctgccctggcaaggctacagagtaccgtgttccgctgtggatgccatccgggtaaccggacccccagtgtgtgtagcggtatgttcacggtccgccgtgttcaccagattcctgacctggctttgctagaaatggtgtgtgcccaatccctgtgaccagtatcaattacatcacctaggaatgctaggaaggtaccccagtcctgagctgggatctgatcctaggctaattgtctacggtgatgctccttttattttcttacaactgctattgactgtctgattgctgattctgctcttgtgctcttctgctctggctcattctcaagggttctctttgtccaagatcctttggttctctccttgttccacttgccactgccaacgcttgtc

SEQ ID NO: 1242 - DNA, 798 bp, Enterovirus G
  EV-G/Pig/JPN/Kana-Ebi1/2019/G1_PL-CP genomic RNA,1
gggttgttcccaccccagggcccactgggcgccagtacactggtacgctagtaccttggtattacggtaccattgtacgccagtacctttgtacgcctgttttatattccctacccccacatgtaactttagaagtttaagtaacaaagaccaataggagtccaacatccagttggattgcggtcaagcacttctgtttccccggacctagtagtgataggctgtacccacggccgaagatgaacccgtccgttatccggccagctacttcgagaagcctagtagcatcaaagatctgtcttggcgtttcgctcagcgcgttccccccgcgtagatcgggctgatgggtctccgcattccccacgggcgaccgtggcggaggccgcgtggcggcccgcctatggcgaaagccataggacgccatttcagtgacagggtgtgaagagcctattgagctagttggtagtcctccggcccctgaatgcggctaatcctaaccactgagcgtccaccagcaaaccagctgggagggcgtcgtaacgggtaactcggtggcggaaccgactactttgggtgtccgtgtttccttttgatcctattgtggctgcttatggtgacaacttacagttgttatcataaagcttttggattggccatccggaaaaagttatcagtgtttgatattgttcggctttcacgcctaccaataagacaatcactttacttgttagttgcattttatcccactaaggatatcactgagttacatcttcaattgctcctaacattatcagcaca

SEQ ID NO: 1243 - DNA, 798 bp, Enterovirus G
  isolate PoEnV-BEL-12R021, complete genome.1
gggttgttcccacccgcggggcccactgggcgctagtacactggtacgccagtaccttggtattacggtaccattgtacgtcagtacctttgtacgcctgttttatatcccttcccccacatgtaacattagaagtcaagtaaacaaagaccaataggagcccaacaaccagttgggttgcggtcaagcacttctgtctccccggacctagtagtgataggctgtacccacggccgaagatgaacccgtccgttatccggccagctacttcgagaagcctagtaacatcaaagatctgtcttggcgtttcgctcagcgcgttccccccgcgtagatcgggctgatgggtctccgcataccccacgggcgaccgtggcggaggccgcgtggcggcccgcctatggcgaaagccataggacgccatttcagtgacagggtgtgaagagcctattgagctagttggtagtcctccggcccctgaatgcggctaatcctaaccacggagcatccaccagcaaaccagctgggagggtgtcgtaacgggtaactctgtggcggaaccgactactttgggtgtccgtgtttccttttgatcctattttggctgcttatggtgacaacgataagttgttatcataaagcttttgggttggccacctggaaaaaattgtcagtgtttgatatcgctcggctttcacgcctaccagtcaaacaagctctttatctccttgttggattctactcaataaaggacataactcagtttcacataaatctgttgctttcattgtcagcaaa

SEQ ID NO: 1244 - DNA, 800 bp, Enterovirus E
  strain EV_NGR_2017, complete genome.1
ggggttgtacccacccctggggcccacgtggcgccagtaccctggtacgttagtacctttgtacgcctgttttccccccccttaaacaaattaagatcgctggtcctgtggggagtagtccgactccgcaccgatacgtcgcaccagcactccggtacgcctagtaccctagtgcggaggtaccagtgtccccccccctcgaaacttagaagcaatgaaccaaaccgacccaaaaggatgcgttgcacccagcagcgtaatggtcaagcacttctgtttccccggccgcaaggtcgttatccgcccgcaccactacgagaagcctattaggcagccaagcttgcaaagcgttgcgttcagccacaaccccagtggtagctctgagagatgggactcgttgttcccccatggtaacatggtgacttgtccgcgtgtgctctcgggttcgccatcaggcgttcacgctgcacaagtgtaactgctgaagagcctattgtgctggagcggttttcctccggaaccgtgaatgctgctaatcctaacctctgagcgtgtgcgcacaaaccagtgttgctacgtcgtaacgcgtaagtcggaggcggaacagactactttcggtactccgtgtttccttattttatatcgtttcatttatggtaacaattactgagattttaaagattgccaagctgcccttaaacattggtttgtattatctagttgcattttataaaacctctgagctttcacttgaattgattgatttcttagtctttctaaacaagcataaattgaggaca

SEQ ID NO: 1245 - DNA, 801 bp, Enterovirus G
  genomic RNA, nearly complete genome,strain:1
cctgtgggttgtacccacccacagggcccaccgggcgccagtacactggtacgccagtaccatggtattacggtaccatgttacgtcagtacctttgtacgcctgttttatatcccctccccgaagtaaccttagaagtttaagtaacaaagaccaataggagtccagcaaccagctggattgcggtcaagcacttctgtttccccggacctagtagtgataggctgtacccacggccgaagatgaacccgtccgttatccggccagctacttcgagaagcctagtagcatcaaagatctgtcttggcgtttcgctcagcgcgtttcccccgcgtagatcgggctgatgggtctccgcataccccacgggcgaccgtggcggaggccgcgtggcggcccgcctatggcgaaagccataggacgccatttcagtgacagggtgtgaagagcctattgagctagttggtagtcctccggcccctgaatgcggctaatcctaaccacggagcgtccaccagcaaaccagctggcggggcgtcgtaacgggtaactctgtggcggaaccgactactttgggtgtccgtgtttccttttgatcctattttggctgcttatggtgacaacaataagttgttatcataaagcttttgggttggccacctggaaaaagttatcagtgtttgatattgttcggctttcacgcctaccaacaaaacaagccttatatttattggttgccttttgtcccttggcggaaattactgattttcacctaaagcttctgattacattgacggcaaa

SEQ ID NO: 1246 - DNA, 803 bp, Kobuvirus cattle/Kagoshima-2-24-KoV/2015/JPN
  genomic RNA, complete1
ttgaaaagggtgtggggggggataccctccccctccacactcttttcgacggcgcgcctcggcaaggccgccgataccgcactgtgctacttcggtaccactctgcgggaatgacaatatgcccggtgtatagtttgcctgtttctcgcaccgttaccgctcgttcgggaatgtgaaactggcacccctcctctcccctaccaccctttctccttcgcccccattcataatttacaacgccgcacacagcggcggccgccaagggctagcctggcggttataaaaggaacctgggtctttccctcttcaagccaaaaggtaggttccctgtgtccctgaatgctcggtgaggaatgctgcaccgtaacgctttgtgaagtgtttgcaagttctggcccggcaagcctacagagtgctgtgatccgctgcggacgccatcctggtaacaggacccccagtgtgcgcaacagtatgttcagacttcggtttgttcacttgctttcatggaccattgcgcgaaagtgcgtgcgccatatccctgtacttcaggtgtgcttctctggaccctaggaatgctgcgaaggtaccccgtttcggcgggatctgatcgcaggctaattgtctatgggttcagtttcctttttctttactccacaattgactgcttaactgactctggatcttgtgcttccactgctctttctgctctcaaaacggcttcacttaccaactctcacctttcgaccaacaccatttacacactaacttttttcgactcttctgactcctggcttggtgaagac

SEQ ID NO: 1247 - DNA, 804 bp, Enterovirus G
  genomic RNA, nearly complete genome,strain:1
ctgtgggttgttcccacccacagggcccactgggcgctagtacactggtatgcctaacctcggtattacggtaccgttgtttacagtacctttgtacgcctgttttatatcccctccccacaagcaactttagaagtatcaagcaaataaggaccaataggagtccaacacccagttggatcatggtcaagcacttctgtctccccggacctagtagtgataggctgtacccacggccgaagatgaaaccgtccgttatccggccagctacttcgagaagcctagtagcatcaaagatctgtcttggcgtttcgctcagcgcgttttcccccgcgtagatcgggctgatgggtctccgcataccccacgggcgaccgtggcggaggccgcgtggcggcccgcctatggcgaaagccataggacgccatttcagtgacagggtgtgaagagcctattgagctagttggtagtcctccggcccctgaatgcggctaatcctaaccacggagcgtttaccagcaaaccagctggcggaacgtcgtaacgggtaactctgtggcggaaccgactactttgggtgtccgtgtttccttttgatcctattgtggctgcttatggtgacaacttacggttgttatcataaagcttttggattggccatccggaaagagttatcagtgtttgatattgttcggctttcacgcctaccattaagacaatcactttatttgttagttgcattttatcctgccaaggacattactgagtttcacctacaactttactcatacaattacatcaagt

SEQ ID NO: 1248 - DNA, 808 bp, Aichivirus B
  genomic RNA, complete genome,strain:U-1.1
tttgaaaagggggtgggggggcttcggccccctcaccctcttttccggcggcgcatgttcgcgtcgtcgtaagtctggattcccaaggcccactcggttcaacttcggtttccggacaaatacaaagaacctcagtcctcttggtactttctcgcctgagtctacaaagcgagaaacctgcccctctaacgccagacgagcggcataaaactcgaacttctggcacgttccaccaccccttctcctatcccaacccccattgcgctctcaaggtcgcgcttttccgagactagctcggattcaaaaagttcctggcaccctttaccccttcaggcccttaaggtaggaactgaccttgtgctgtgatctcggtgcggaagtgctactgcgtagtgattgtaagatccttttgtggttctgccctggcaaggctacagagtgctgtgatccgctgcggatgccatcctggtaacaggacccccagtgtgcgcaacagtatgttcacggtcttccgtgttcaccacattcggaacactgctttcgtgaaacagtgtgtgtccaatccctgtgatcagtatcaaccacaccacctaggaatgctaggaaggtaccccggttcgccgggatctgatcctaggctaattgtctacggtggtgctcctttttattttccacttcaactcactggttacaactgcttgatttctgtgtttgctgcttttctctgctctcactgccattctcaagtgttcacactgtccaagctcctttggttgttcgcttccacttgccactgtcaactcttgtc

SEQ ID NO: 1249 - DNA, 809 bp, Porcine enterovirus 9
  strain UKG/410/73 polyprotein gene, complete1
ttaaaacagcctgtgggttgttcccacccacagggcccactgggcgctagtacactggtatgccttacctcggtattacggtaccgatgtatatagtacctttgtacgcctgttttatatccctcccccacatgtaaccttagaagtttacacaaacaaagaccaataggagtccaacacccagttggattgcggtcaagcacttctgtttccccggacctagtagtgataggctgtacccacggccgaagatgaacccgtccgttatccggctacctacttcgggaagcctagtaacattctgaagtctctgaggcgtttcgctcagcacgaccccggtgtagatcgggctgatgggtctccgcataccccacgggcgaccgtggcggaggccgcgttggcggcccgcctatggcgaaagccataggacgcctcttagatgacagggtgtgaagagcctactgagctgggtagtagtcctccggcccctgaatgcggctaatcctaaccacggagcgtccaccagcaatccagctggcagggcgtcgtaacgggcaactctgtggcggaaccgactactttgggtgtccgtgtttccttttgatcctattttggctgcttatggtgacaacgataagttgttatcataaagctcttgggttggccacctggaaaaagttatcagtgtttgatattgttcggctctcacgcctaccaataagacaagccctatatttacttgttgcattttactcgtcagaagaaatcacagagtatcatttggatttgttactcacattaaggacaag

SEQ ID NO: 1250 - DNA, 809 bp, Enterovirus F
  genomic RNA, complete genome,strain: BEV Ho12/Bos1
gggggttgttcccacccctggggcccacgtggcgccagtactctggtacgttagtacctttgtacgcctgttttcccctcccttaaacaaattaagattaccactactgaggggagtagtccgactccgctccagcactgctgcaccagtgaattggtacgctagtacctctgcacggagtagatggtatcccccccccgaaacttagaagtttgcaacaaacccgaccaataggtgcgtggcatccagctgcgtaaaggtcaagcacttctgtttccccggtccacaaggatcgttacccgcccaacccactgcgagaagcctattaactggccaaacaactgaagagttgcgctccgccacgacccctgtggtagctctggaagatggggctcgcacttcccccgtggtaacacggttgcctgcccgcgcgtgcttccgggttcgacctagtgtcgttcactccaaagttgcgtaaccagccaagagcctattgcgctgggatggttttcctccggggccgtgaatgctgctaatcctaacctccgagcgtgtgcgcacaaaccagtgttgctacgtcgtaacgcgtaagttggaggcggaacagactactttcggtaccccgtgtttcctcttatttttatataatattttatggtgacaattgctgagatttgtgatttggccaccctaccattgaatattgctttgtattatctggttgcatttcataaagcttcagaaatacctgcttcctatatcgatctacttgtattcctcaatttaaagcacaaattagagaacataag

SEQ ID NO: 1251 - DNA, 811 bp, Porcine enterovirus G1
  isolate 13-03212, complete genome.1
ttaaaacagcctgtgggttgttcccacccacagggcccactgggcgctagtacactggtatacttagcctcggtattgcggtaccggtgtatatagtacctttgtacgcctgttttatgtcccctcccccttaagtaacattagaagtttgaacaaacaaagaccaatagaggtccaacatccagttggattgcggtcaagcacttctgtctccccggacctagtagtgataggctgtacccacggccgaagatgaactcgtccgttatccggctatccacttcgggaagcctagtagcatcaaagctctgtcgaggcgtttcgctcagcacgtaaccccagtgtagatcgggctgatgggcctccgcataccccacgggtgaccgtggcggaggccgcgtggcggcccgcctatggcgaaagccatgggacgcctcttggatgacagggtgtgaagagcctactgagctgggtagtagtcctccggcccctgaatgcggctaatcctaaccacggagcgtccaccaacaaaccagttggcagggcgtcgtaacgggtaactctgtggcggaaccgactactttgggtgtccgtgtttccttttgatcctatgttggctgcttatggtgacaacgataagttgttatcataaagcttttgggttggccacctggaaaacgatatcagtgtttgacattgttcggctttcacgcctaccaacgagaaaagctctttattgctgagttgcattttatccaaaagaggtaataaccaccttccatttacaactcttactcacattatcatcaag

SEQ ID NO: 1252 - DNA, 812 bp, Enterovirus E
  strain BJ101, complete genome.1
ttaaaacagcctgggggttgtacccacccctggggcccacgcggcgccagtactctggttcgattagaacctttgtacgcctgttttcccctcccttaaacaaattaagatctctgccaatgtggggagtagtccgactccgcaccgatacgtcgcaccagcagaccggttcgcttaggacccttctgcggattggtatgagtccctctcccgaaacttagaagtttggacaaaccgaccaataggtgcgtggcatccagccatgttacggtcaagcacctctgtttccccggtcagaaatgatcgttacccgccctacccactacgaaaagcctattaaccattgaaagtgatgaggagttgcgctcagccatgaccccgatggtagctctgagggatggagctcgcagttcccccgtggtaacacggttgcttgctcgcgtgtgcccttgggttcgaccatttggtcgttcactccaaatcatcgtaaatggccaagagccaattgtgctggggaggttttcctccggagccgtgaatgctgctaatcccaacctccgagcgtgtgcgcacaatccagtgttgctacgtcgtaacgcgtaagttggaggcggaacagactactttcggtactccgtgtttccttttattttattattatattaatggtgacactgtttgagatttgcgagattgccaaattgccactcaacattgcactctattatttggtatcattctacaatacctcagaacttacggttgagctcattgatttcctcgtctttttgaataaaaataaattaaagaca

SEQ ID NO: 1253 - DNA, 813 bp, Enterovirus G
  genomic RNA, nearly complete genome,strain:1
taataacagtctatgggttgttcccacccacagggcccactgggcgtcagtacactggtatgccagtaccttggtatcacggtaccattgtacgccagtacctttgtacgcctgttttatattcccttccccatacgtaactttagaagtttaagcaaattaagaccaataggagtccaacaaccagttggattgcggtcaagcacttctgtttccccggacctagtagtgataggctgtacccacggccgaagatgaacccgtccgttatccggccagctacttcgagaagcctagtagcatcaaagatctgtcttggcgtttcgctcagcgcgttccccccgcgtagatcgggctgatgggtctccgcataccccacgggcgaccgtggcggaggccgcgtggcggcccgcctatggcgaaagccataggacgccatttcagtgacagggtgtgaagagcctattgagctagttggtagtcctccggcccctgaatgcggctaatcctaaccactgagcgtccaccaacaaaccagttgggagggcgtcgtaacgggtaactcggtggcggaaccgactactttgggtgtccgtgtttccttttgatcctattttggctgcttatggtgacaacgataagttgttatcataaagcttttgggttggccacctggaaaaagttatcagtgtttgatattgttcggctttcacgcctaccattcagactaactctttatttgcttattgcattttacccatcggaggatattacagacttccatctacaactcttattcacattatcaacaca

SEQ ID NO: 1254 - DNA, 814 bp, Enterovirus E
  strain BEV-GX1901 polyprotein gene, complete cds.1
ttaaaacaggctgggggttgtacccacccccggggcccacgcggcgccagtactctggttcgattagaacctttgtacgcctgttttccccacccttaaataaatcaagatctctgccaatgtggggagtagtccgactccgcaccgatacgtcgcaccagcagaccggttcgcttaggacccttctgcggattggtatgagttcccacccttgtaacttagaagttctcacaaaccgaccaatagcggcgttgcatccagcagcgcaacggtcaagcacttctgtttccccggcgcgtcgcgtcgttacccgcccggtctactacgggaagcccagtatggtcccaattgattgcgcagttgcgttcggccacaaccccagtggtagctctgaggaatggggctcgcccttcccccacagtaatgtggtggcctgcccgcgcgtgtcctcgggttcactcctagagtgttcactgcaattttgagtaagatctgaagagcctactgtgctaggttggttttcctccggagccgtgaatgctgctaatcccaacctccgagcgtgtgcgcacaatccagtgttgctacgtcgtaacgcgtaagttggaggcggaacagactactttcggtactccgtgtttccttattttattcacttattttatggtgacactgactgatatttgtgagtttgctcggctgcccttgaatattgctttgtactatttaatagcatttcatagaaccactcaactttcaattgagcttattgacttcgccgtctttctcaatcagatacacaaaaccacacata

SEQ ID NO: 1255 - DNA, 814 bp, Porcine enterovirus 10
  strain LP 54 polyprotein gene, complete cds.1
ctaaaacagcctgcgggttgtacccgcccgcagggcccactgggcgctagtactctggtacgctagtacactagcacgttagtgcttttgtacgccagtacctttgtacgcctgttttattttcccttccccacatgtaactttagaagtttagaaacaaacaatgaccaataggagtccagcatccagttggattgcggtcaagtacttctgtttccccggacctagtagtgataggctgtacccacggccgaagatgaacccgtccgttatccggctacctacttcgggaagcctagtaacattctgaagtctctgaggcgtttcgctcagcacgaccccggtgtagatcgggctgatgggtctccgcataccccacgggtgaccgtggcggaggccgcgttggcggcccgcctatggcgaaagccataggacgcctcttagatgacagggtgtgaagagcctactgagctgggtagtagtcctccggcccctgaatgcggctaatcctaaccacggagcgtccaccggcaaaccggtcgggagggcgtcgtaacgggtaactctgtggcggaaccgactactttgggtgtccgtgtttccttttgatcctattttggctgcttatggtgacaacgataagttgttatcataaagcttttgggttggccacctggaaaaagttatcagtgtttgatattgttcggctctcacgccttccaacaaaacaggccttacttcttttaattgcattttatccatcggaggttattacagatttccatctgaagcttcttctcacagtagcagtaaa

SEQ ID NO: 1256 - DNA, 814 bp, Enterovirus G
  genomic RNA, nearly complete genome,strain:1
aaaccagtctgtgggttgttcccacccacggggcctactgggcgccagtggactggtacgccagtaccttggtatcacggtaccactgtacgctagtacctttacacgcctgttttataccccttccccaaacgtaacattagaagtttaacaagcaaagaccaataggagtccaacacccagttggattgcggtcaagtacttctgtctccccggacctagtagtgataggctgtacccacggccgaagatgaaaccgtccgttatccggccagctacttcgagaagcctagtagcatcaaagatctgtcttggcgtttcgctcagcgcgttttcccccgcgtagatcgggctgatgggtctccgcataccccacgggcgaccgtggcggaggccgcgtggcggcccgcctatggcgaaagccataggacgccatttcagtgacagggtgtgaagagcctattgagctagttggtagtcctccggcccctgaatgcggctaatcctaaccacggagcgtttaccagcaaaccagctggcggaacgtcgtaacgggtaactctgtggcggaaccgactactttgggtgtccgtgtttcctgttgatcctattttggctgcttatggtgacaacgataagttgttatcataaagcttttgggttggccacctggaaaaaagttatcagtgtttgatattgttcggctttcacgcctaccattaagacaatcactttatttgttagttgcattttatcctgccaaggacattactgagtttcacctacaacttttactcatacaattacatcaagt

SEQ ID NO: 1257 - DNA, 814 bp, Enterovirus E
  isolate VD 2860/1-99 polyprotein gene, partial cds.1
ttcaaacagcctgggggttgtacccacccctggggcccacgtggcgctagcactctggtatgcttagtacctttgtgcgcctgttttcccctcccttaaacaaattaagattgccactactgaggggagtagtccgactccgctccggtacagccgcaccagtactccggtgcgcatagcaccctagtacggagtaggtggtatcccttcccgaaacttagaagttatgaaccaaaccgaccaataggagcgtggcatccagccatgttgtggtcaagcacttctgtttccccggtccgcaaggatcgttacccgcccgacccactacgagaagcctattaactggccaagcgattgcgaagttgcgctcagccacaatcccagtggtagctctggaagatggggctcgcactccccccgtggtaacacggttgcttgcccgcgtgtgcttccgggttcggtcaccgaccgttcacttcaatctcgcgtaaccagccaagagccgattgtgctgggacggttttcctccggggccgtgaatgctgctaatcctaacctccgagcgtgtgcgcacaaaccagtgttgctacgtcgtaacgcgtaagttggaggcggaacagactactttcggtaccccgtgtttcttttgatttattttgtattttaatggtgacactgactgacatttgtgagtttgctcgattgcctttgaatattgctctgtattatctaatagcatttcacaagactacccaactttcactcgagcttattgactttgctgtttacttgaaccgcatacacaaactcaaca

SEQ ID NO: 1258 - DNA, 815 bp, Ovine enterovirus
  strain ovine/TB4-OEV/2009/HUN, complete genome.1
taaacagtcagggggttgtacccacctccggggcccacgtggcgtcagtgctctggtgcgttagtacctttgcacgcctgttttcccttcccttaaacaaattaagatcgccagcgccgaggggagtagtccgactccgctccactacggtgctccagtggattgctattacggtagctcttcacggggtggctggtgtccccaaccccgcaacttagaagccagcacagatcgaccaatagcggctcggcagccagtcgggcaacggtcaagcacttctgtttccccggtccgtaaggatcgttacccgcccaggatgctacgagaaacttagtaaacacccaagcttgtgagaggttgcgctcagccacaaccccagtggtagctctgagtgatggggctcgtgactacccctctggtaacagagacacttgcccgcgtgtgcactcgggttcatcagaaatggtgttcacctcgaccaagcgtaagtgttgaagagtctattgtgccagcctggtttcctccggggccgtgaatgctgctaatcctaacctccgagcgtgtgcgcacaatccagtgttgctacgtcgtaacgcgtaagttggaggcggaacagactactttcggtaccccgtgtttcctcattcattatttcaatttatggtgacaattacagagatttgtgaattggcgaaactaccactgaatttggccttgtattgtcttattgccttccacaaaacttctgatattccacccagttatatcgatctcctggtttatctaaatttacaatataaattgaaccagataca

SEQ ID NO: 1259 - DNA, 816 bp, Enterovirus E
  isolate V251, complete genome.1
ttaaaacagcctaggggttgttcccacccctggggcccacgcggcgctagtactctggtacgtcagcacccttgtacccccgtttttccctcccttaaacaaattaagattaccactactgaggggagtagtccgactccgctccggtactgccgcaccagtactccggtacgtttagtactctagtacggagtagatggtatcccccacccttgcaacttagaaggaatcaaactacccgaccaataggcgcgcggcatccagccgcgttacggtcaagcacttctgtttccccggtccgcaagggtcgttatccgcccgctccactacgaaaagcctagtagccaaccaaacgactgcgaagttgcgttcagccacaaccccagtggtagctctggaagatggggctcgcaatacccccgtggtgacacggttgcttgcccgcgcgtgcttccgggttcggtcatgtaccgttcactttaatgtcgtgtaattggtcaagagcctattgtgctggagcggttttcctccggggccgtgaatgctgctaatcccaacctctgagcgtgtgcgcacaaaccagtgttgctacgtcgtaacgcgtaagtcggaggcggaacagactactttcggtaccccgtgtttcacttatttttactttatattttatggtgacacttgctgatatttgtgaatttgctcgcttgccgttgaacatagccttgtattatttagtagcattttacaacacaagccagctttcagttgaactcattgattttgctgtttacctcaattacatacacaaacacaaca

SEQ ID NO: 1260 - DNA, 816 bp, Yak enterovirus
  strain SWUN-AB001, complete genome.1
tttaaacagtctgggggttgttcccacccctggggcccacgtggcgctagcactctggtacgctagtacctttgtacgcctgttttccccacccttaaataaattaagattaccactaccgaggggagtagtccgactccgctccggcacagccgcaccagtgcactggtacgctagtaccttttcacggggtagtcggtatccccccccgtaacttagaagcatgtaacaaaccgaccaataggtgcgcggcagccagctgcgttgcggtcaagcacttctgtctccccggtccgcaaggatcgttacccgcccactccactacgaggagcctagtaactggccaagtgattgcggagttgcgttcagccacaaccccagtggtagctctggaagatggggctcgcacatcccccgtggtaacacggttgcttgcccgcgtgtgcttccgggttcagtctccgactgttcacttcaacatcacgcaaccagccaagagccgattgtgctggagtggtcttcctccggggccgtgaatgctgctaatcctaacctccgagcgtgtgcgcacaatccagtgttgctacgtcgtaacgcgtaagttggaggcggaacagactactttcggcaccccgtgtttcctttattttattcttattttatggtgacaattgcagagatttgtgatattgcgactttaccgttaaacatagcactgcattacctggttgcattccacaaaacttcagagattcctagttcctacattgacctacttgtttatttgaatcttaaatacaaacttgagcaagtgaa

SEQ ID NO: 1261 - DNA, 816 bp, Enterovirus E
  isolate D 14/1/96 polyprotein gene, partial cds.1
ttcaaacagcctgggggttgtacccacccctggggcccacgcggcgccagtactctggtacgctagtacctttgtacgcctgttttcccctcccttaaacaaattaagattgccactactgaggggagtagtccgactccgctccgacactgtcgcaccagtactccggtacgcttagtaccctagtacggagtaggtggcatccccaccccgaaacttagaagtatgcaaacaaaccgaccaataggcgcgcggtatccagccgtgtgaaggtcaagcacttctgtctccccggtccgtaaggatcgttacccgcccgacctactacgaaaagcctagtagttggccaagcgagcacgaggttgcactcaaccacaaccccagtggtagctctggaagatggggctcgcagttcccccgtggcaacacggttgcttgcccgcgtgcgcttccgggttcggacttgtgccgttcacctcaaactcgcgtaaccagcgaagagccgattgtgctaggacggttttcctccggggccgtgaatgctgctaatcccaacctccgagcgtgtgcgcacattccagtgttgctacgtcgtaatgcgtaagtcggaggcggaacagactactttcggtaccccgtgtttcctcttattttatttacattttatggtgacactgactgacattcgtgagctagcccgcttgcctctcaatattgcactttattatttggtagcattttacaatactctcgaacttacccttgagcttgttgatttcatcgtttacctaaatcggcttgacaaaggatacaata

SEQ ID NO: 1262 - DNA, 817 bp, Enterovirus E3
  polyprotein gene, partial cds.1
ttaaaacagcctgggggttgtacccacccctggggcccacgtggcgccagtactctggtacgctagtacctttgtacgcctgttttccccacccttaaataaattaagattaccactactgaggggagtagtccgactccgctccgacactgccgcaccagtattccggtacgcttagtaccctaatacggagtagatggtatccccaccccgcaacttagaagcatgcaaacaacccgaccgataggagcgcggcatccagtcgcgtataggtcaagcacttctgtttccccggtccgaaaggatcgttacccgcccaacccactacgagaagcctagtaactggccaaacaaccgcaaagttgcgctcagccacaaccccagtggtagctctggaagatggggctcgcacctcccccgtggtaacacggttgcttgcccgcgtgtgcttccgggttcggcctagtgccgttcactttaaagttgtgtaaccagcaaagagcctattgtgctgggatggttttcctccggggccgtgaatgctgctaatcccaacctccgagcgtgtgcgcacaaaccagtgttgctacgtcgtaatgcgtaagttggaggcggaacagactactttcggtaccccgtgtttccttttattgttatttacattttatggtgacactgactgacatttgtgaatttgctcgcttgcctctcaatattgcactatattacctgattgcatttcacaacactagtaaactaacccttgaacttatcgactttgctgtttacctaagtcacttaaatcacaagtacaata

SEQ ID NO: 1263 - DNA, 817 bp, Enterovirus E
  isolate D 58/96-V2130 polyprotein gene, partial cds.1
ttcaaacagcctgggggttgtacccacccctggggcccacgtggcgccagtactctggtacgttagtacctttgtacgcctgttttcccctcccttaaataaattaagattgccactactgaggggagtagtccgactccgctccggcactgccgcaccagtactccggtacgcctagtaccctagtacggagtagatggtatcccccccccgaaacttagaagtaatgagtctaaccgaccaataggcgcgcggcatccagccgtgttacggtcaagcacttctgtttccccggtccgcaaggatcgttacccgcccgacccactacgagaagcctattaactggccaagcgtcagtgaagttgcactcagccacaaccccagtggtagctctggaagatggggctcgcatctcccccgtggtaacacggttgcttgcccgcgcgtgcttccgggttcagcctcgcgctgttcacttcaatgacacgtaaccagccaagagccgattgtgctgggacggttttcctccggggccgtgaatgctgctaatcctaacctccgagcgtgtgcgcacaatccagtgttgctacgtcgtaacgcgtaagttggaggcggaacagactactttcggtaccccgtgtttcccttaaatttttccttaaatatatggtgacattgactgacatttgtgagtttgctcgcttgccaatcaacattgcactctattacctaatagcatttcacaatacttgtgaactcacccttgaacttgtcaatttctccgcctatttgaactacttaaatagaaagtataaca

SEQ ID NO: 1264 - DNA, 818 bp, Enterovirus E4
  strain bovine enterovirus,strain MexKSU/5, complete1
tttaaaacagctcgggggttgttcccactcccggggcccacgtggcgctagtactctggtacgttagtaccttgtacgcctgttttcccctccttaaacaaattaagattaccactactgaggggagtagtccgactccgctccagcactgctgcaccagtgaattggtatgattagtacctcttcacggagtagatggtattcctaccccgcaacttagaagtttattaacaaaccgaccaataggtgcacagtatccagctgtgtaacggtcaagcacttctgtttccccggtccaccaggatcgttacccgcccgacccactacgagaagcctagtaactagccaagtgactgcgaagttgcgctcaaccacaaccccagtggtagctctggaagatggggctcgcacctcccccgtggtaacacggttgcctgcccgcgtgtgcttccgggttcggccttgtgccgttcacttctacgtcatgtaactagccaagagcctattgtgctgggacggttttcctccgggaccgtgaatgctgctaatcctaacctccgagcgtgtgcgcacaatccagtgttgctacgtcgtaacgcgtaagttggaggcggaacagactactttcggtaccccgtgtttcctcttttattatattatttaatggtgacaattgcagaaatttgtgatttagcgactttaccattgcacatagcattatattgtttgattgctttccacaaaacatctgatatacccaactcttatatcgatctacttatctttctttgcttgaagaataaattaaagaaagcacg

SEQ ID NO: 1265 - DNA, 818 bp, Bovine enterovirus
  genomic RNA, complete genome.1
ttaaaacagcctgggggttgtacccacccctggggcccacgtggcgctagtactctggttcgttagaacctttgtacgcctgttttcccctccttaaacaaattaagatctctgccaatgtggggagtagtccgactccgcaccgatacgtcgcaccagtagaccggttcgcttaggacccttctacggattggtatgagttccccaccccgtaacttagaagtactagcaaaaccgaccaataggagcgtggcacccagctgcgttaaggtcaagcacttctgtctccccggccagaaatggtcgtcacccgccctctctactacgagaagcctattaaccattgaaggcgatgaggagttgcgctccaccacaaccccagtggtagctctgagagatggggctcgcagtcacccccgtggtaacacggttgcttgcccgcgtgtgctctcgggttcggccacttggccgttcactccaactcgttgtaagtggccaagagcctattgtgctagagaggttttcctccggagccgtgaatgctgctaatcccaacctccgagcgtgtgcgcacaatccagtgttgctacgtcgtaacgcgcaagttggaggcggaacagactactttcggtactccgtgtttccttattattttatacaacaatttatggtgacattgactgatactattgagttcgcccgcttgccattgaatattgccttgtattaccttatagcatttcaaaaagccacagatctcaccctcgagctcattcactttgcagtttgtttgaatcgcatacacaagacatttgaac

SEQ ID NO: 1266 - DNA, 818 bp, Enterovirus E
  strain LC-R4 polyprotein gene, complete cds.1
ttaaaacagcctgggggttgtacccacccccggggcccacgtggcgccagtactctggtttgcttagaacctttgtacgcctgttttcccccccctttaaataaattaagatctctgccaatgtggggagtagtccgactccgcaccgatacgtcgcaccagcagaccggttcgcctagaacccttctgcggattggtatgagttcctccccgaaacttagaagcaccgcaccaaccgaccaataggagcgtggcacccagccatgttacggtcaagcacttctgtttccccggtcagaaatgatcgttatccgccctctcccctacgagaagcctattaaccaccgaacgtggtgaagagttgcgctcagccacaatcccagtggtagctctgagagatggggctcgcatttcccccgtggtaacacggttgcttgcccgcgcgtgctctcgggttcagtcttctgactgttcactctgaaccacggtaagtggccaagagcctattgtgctggagaggttctcctccggagccgtgaatgctgctaatcccaacctctgagcgtgtgcgcacaatccagtgttgctacgtcgtaacgcgtaagtcggaggcggaacagactactttcggtactccgtgtttccttattatctattaatcaatttatggtgacactgactgatattgttgagtttgctcgattgcccttgaacattgccttatactatcttattgcattttaatagagccacagagcttactgttgagcttattgactttgctgtttacttgaatcaaatatacgcattagataaac

SEQ ID NO: 1267 - DNA, 819 bp, Bovine enterovirus type 2
  strain PS87, complete genome.1
tttaaaacagcctgggggttgtacccacccctggggcccacgcggcgctagtactctggtacgttagtacctttgtacgcctgttttcccctcccttaaataaattaagattaccactactgaggggagtagtccgactccgctccgacaatgtcgcaccagtgcactggtacgctagtaccttttcacggagtagctggtattccctcccgaaacttagaagcacttaaatcaaccgaccaataggcgcgcggtagccagccgcgttacggtcaagcactcctgtttccccggtccacaaggatcgttacccgcccgacccactgcgagaaacctagtagttggccaagtggtaacgaggttgcgctcagccacaaccccagtggtagctccggaagatggggctcgcaccacccccgcggtaacgcggttgcttgcccgcgcgtgcttccgggtccggtctcgtaccgttcacctcaataccacgtaaccagcaaagagtctattgcgctgggacggttttcctccggggccgtgaatgctgctaatcccaacctccgagcgtgtgcgcacaatccagtgttgctacgtcgtaacgcgtaagttggaggcggaacagactactttcggtaccccgtgtttccctatcattccatttcattttatggtgacaattgctgagatctgtgatttggcgaccttaccactgaatattgccttatattacttggttgcattccacaaaacctctgacatacctgcttcctatatcgacctacttgttttcctcaatttaaagtatagactacaaatagcaga

SEQ ID NO: 1268 - DNA, 819 bp, Enterovirus E
  isolate D 8/01 polyprotein gene, partial cds.1
ttaaaacagcctgggggttgtacccacccctggggcccacgtggcgctagtactctggttcgtttagaacccttgtacgcctgttttcccctcccttaaacaaattaagatctctgccaatgtggggagtagtccgactccgcaccgatacgtcgcaccagcagaccggttcgcttagaacccttctgcggattggtatgagttccccccccttgcaacttagaagcatgagaacaaccgaccaataggagcatggcatccagccgtgtcacggtcaagcacttctgtttccccggccagagatggtcgttacccgccctacccactacgagaagcctattaactaccgaaatcagcgaagagttgcactcagccacaaccccggtggtagctctgagagatggggctcgcaacaacccccgtggtaacacggttgcttgcccgcgcgtgctctcgggttcagtctttgactgttcactccgacctgacgtaagtagccaagagcctattgtgctgggaaggttttcctccggagccgtgaatgctgctaatcctaacctccgagcgtgtgcgcacaaaccagtgttgctacgtcgtaacgcgcaagttggaggcggaacagactactttcggtactccgtgtttccttattttattaactccaatttatggtgacattgactgatattgttgtatttgcccgcctaccgttgaacatagctttatatcatctcattgcattcaagaaatccacagagcttaccctggaactccttgactttgcagttttcttaaatcggatacataaactcagtaaga

SEQ ID NO: 1269 - DNA, 819 bp, Enterovirus E
  isolate 56/59/1 polyprotein gene, partial cds.1
ttcaaacagcctgggggttgtacccacccccggggcccacggggcgccagtactctggtatgcttaatacctttgtacgcctgtttttccctcccttaaataaattaagattaccactactgaggggagtagtccgactccgctccggtaccgccgcaccagtactccggtacgctcagtaccctagtacggagtagttggtattccctccctgtaatttagaagtatgaaattaaaccgaccaataggaggcgtggcatccagtcgcgttacggtcaagcacttctgtttccccggtccgtaaggatcgttacccgcccgacccactacggaaagcctagtaactggccaactggatgagaggttgcactcagccacaaccccagtggtagctctggaagatggggctcgcaccttcccccgtggtaacacggttgcttgcccgcgtgtgctcccgggttcggtccccgaccgttcacttcgattccaggtaaccagccaagagccaactgtgctgggacggttttcctccggggccgtgaatgctgctaatcctaacctccgagcgtgtgcgcgcaaaccagcgttgctacgtcgtaacgcgtaagttggaggcggaacagactactttcggtaccccgtgtttccttttattttacttattgtttatggttacactgactgatatttgtgagtttgctcgtttgcctttgaatattgctttgtattactttgttgcttttcacaaaacgacccagctcaccgttgaacttgtcgattttgctgtttttcttaatctaacctacaagaaacttaaca

SEQ ID NO: 1270 - DNA, 820 bp, Sicinivirus A3
  isolate 100C, complete genome.1
agtattaatgttgccgaattggactgacacaagttgaggagcacatagggcatggttgtaagaccactagcttgtacattccatgggcgatgctgggggtccacgtagccctcaggggaggcggtgacaagcagcgccccggccagtggcagacttgcaaaatttcctaccaaaccaccatctcactcctattaccccttccctctatacctttcgttatggtggttaccactgtttcattgccttggctgaaaatggccaccctctcgacacatgccccttgctgccccatcgtgcgactttccatttgtccactcagttagaaaagcacgggggtcctgtctgcgtcccgagcccggttggtgatcttcctcccccccgcccgattgatggcccggaggggtttgctgatgcgctttatgatgcttgcctgtccttcctccgtcggcgcgaacatgcgctcgttgagcttgcggaaatacagccttgcttccgtttctcccaccccgcataccctggccgcctcccgcttgaaattcgcttcgtccggcatcctggtgtgcctcccccgctgcgtgactttacccgtggcattcgacgccctggcattcagtacattccgctacctaacctaggcggtctcccccagtcccccgctcccccaattgcacacgtgatatccgccgctgtcaatgccgtgcgccgcggtagccactggcattgtcctctgcttcgtcaagtgtccactcacggctggctatttacctattctggctattggtgctctatcctgttgcatgaggggcgacatgaccacgac

SEQ ID NO: 1271 - DNA, 820 bp, Bovine enterovirus type 2
  strain 3A, complete genome.1
tttaaaagagtcagggggttgtacccacccctggggcccacgtggcgctagtactctggtacgccagtacctttgtacgcctgttttcccctccctaaataaattaagattaccactactgaggggagtagtccgactccgctccggcaatgccgcaccagtgcactggtacgctagtaccttttcacggagtagatggtattcctcaccccgaaacttagaagcacgaaaacaaaccgaccaataggtgcatggcatccagccgtgttatggtcaagcacttctgtttccccggtccgcaaggatcgttacccgcccgacccactacgagaagcctagtaactgaccaagtagttgagaggttgcgctcagccacaaccccagtggtagctctggaagatggggctcgcacttcccccgtggtaacacggttgcttgcccgcgcgtgcttccgggttcggcctctgccgttcacctcgattctgcgtaatcagccaagagcctattgtgctgggacggtttcctccggggccgtgaatgctgctaatcccaacctccgagcgtgtgcgcacaatccagtgttgctacgtcgtaacgcgtaagttggaggcggaacagactactttcggaaccccgtgtttcctttgttttaattttaatgctttatggtgacaattgttgagatctgcgatctagcgaccttgccattgaacattgctttgtattatttggttgcattccacaaaacctctgacatacccagctcctatattgatcttttggtttatctaaacttaaaacacaaactcgaaggattgcg

SEQ ID NO: 1272 - DNA, 820 bp, Enterovirus E
  isolate Vir 404/03 polyprotein gene, complete cds.1
ttcaaacagcctgggggttgtacccacccctggggcccacgcggcgccagtactctggtacgcttagtacctttgtacgcctgttttccctttcccttaaacaaattaagattaccactgttgaggggagtagtccgactccgctccggcactgccgcaccagtactccggtatgcctagtaccctagtacggagcagatggtatccccctttccctgaaacttagaagtctgacgcaaacccgaccaataggagcgcggtatccaaccgcgtaacggtcaagcacttctgtttccccggtccgcaaggatcgttacccgcccgtcccactacgggaagcctagtaactggccaactgagtgagaggttgcgctcagccacatacccagtggtagctctggaagatggggctcgcactccccccgtggtaacacggttgcttgcccgcgtgtgcttccgggttcggtttcgaccgttcacctcaaccccaggtaaccagccaagagcctactgtgctggagcggttttcctccggagccgtgaatgctgctaatcccaacctccgagcgtgtgcgcacaaaccagtgttgctacgtcgtaacgcgtaagttggaggcggaacagactactttcggtactccgtgtttccttttgttttatctattgtttatggtgacactgtctgacatttgtgaatttgctcgcttacccttgaatattgcattgtattatctggttgcatttcacaacacaacccaactctccattgaactcatcaactttgctgtatttcttaacacaatacaaagaaagcgagata

SEQ ID NO: 1273 - DNA, 820 bp, Enterovirus E
  strain PS 83 polyprotein gene, complete cds.1
ttaaaacagcctgggggttgtacccacccccggggcccacgcggcgctagtactctggttcgtttagaacccttgtacgcctgtttttcccccccttaaataaattaagatctctgccaatgtggggagtagtccgactccgcaccgatacgtcgcaccaacagaccggttcgcctaggacccttctgcggattggtatgagtcccccccccgaaacttagaagcacattacaaactggccaataggagcgtggtatccaaccgcgttgcggtcaagcacttctgtttccccggtcagaaatgatcgttacccgccctccccactacgagaagcctattaaccactgaaagtgatgatgagttgcgctcagccacaaccccggtggtagctctgagagatggggctcgcaccacccccgtggtgacacggttgcttgcccgcgtgtgctctcgggttcagtcgcgagactgttcactctgactcattgtaggtggccaagagcctattgtgctggggaggttttcctccggagccgtgaatgctgctaatcccaacctccgagcgtgtgcgcacaatccagtgttgctacgtcgtaacgcgtaagttggaggcggaacagactactttcggtactccgtgtttccttaattttattgttcaaatttatggtgacattgtctgacatttgtgaattcgctcgcctgccacttaatatcgctttatatcatctgatagcattccataagactacagaactcactttggaactcatcgactttgctgttttcctgaatactgttcacaaccaaacaaaacaaa

SEQ ID NO: 1274 - DNA, 821 bp, Enterovirus AN12
  genomic RNA, complete genome,strain: AN12.1
ttaaaacagcctgggggttgttcccacccccggggcccacgtggcgccagtactctggcacgttagtgcccttgtacgcctgttttcccctccttaaacaaattaagattgccactactgaggggagtagtccgactccgctccagtaccgctgcaccagtgagctggtacgctagtaccttcgcacggagtagatggcatcccccaccccgtaacttagaagcaaagtacacatctggccaatagtggcgctgcatccagccgcgcaacggtcaagcacttctgtttccccggtccgcaagggtcgttatccgcccagtccactacggaaagcctactaaccattgaagctatcgagaggttgcgctcggccacgaccccggtggtagctctgagtgatggggctcgcaaacacccccgtggtaacacggatgcttgcccgcgcgtgcactcgggttcagcctattggttgttcacctcaacatagtgtaaatggccaagagcctactgtgctggattggttttcctccggagccgtgaatgctgctaatcccaacctccgagcgtgtgcgcacaatccagtgttgctacgtcgtaacgcgtaagttggaggcggaacagactactttcggtactccgtgtttcttttgttttattttgaattttatggtgacaattgctgagatttgcgaattagcgactctaccgctgaacattgccctgtactacctaatcgcatttcacaaaacctcagagataccaagctcttacattgatctgcttgttttcctgaatctcaaatataaattggaacaagcaaa

SEQ ID NO: 1275 - DNA, 821 bp, Enterovirus E
  isolate Jena 38/02 polyprotein gene, partial cds.1
ttcaaacagcctgggggttgtacccacccctggggcccacgtggcgctagtactctggtacgttagtacctttgtacgcctgttttcccctcccttaaacaaattaagattaccactactgaggggagtagtccgactccgctccggtactgccgcaccagtactccggtacacttagtaccctagtacggagtagatggtatccccaccccgcaacttagaagcatgcaaacaaaccgaccaataggcgcacgatatccagtcgtgtttcggtcaagcacttctgtctccccggtccgaaaggatcgttacccgcccgacccactacgagaagcccagtaactggccaagtgattgcgaagttgcgctcagccacaaccccagtggtagctctggaagatggggctcgcgtctcccccgtggtgacacggtcgcttgcccgcgtgtgcttccgggttcggcctacgccgttcacttcaatgtcacgtaaccagccaagagcctattgtgctgggacggttttcctccggggccgtgaatgctgctaatcccaacctccgagcgtgtgcgcacaacccagtgttgctacgtcgtaatgcgtaagttggaggcggaacagactactttcggtaccccgtgtttcctttaaattttattcattattttatggtgacaattgctgagatctgcgaattagcgactctgccgttgaatattgctctgtactatttggttgcattccacaaaacctctgacatccccagtacatacattactttacttgtttacctcaatctaaagcacaagctagataatacaaa

SEQ ID NO: 1276 - DNA, 822 bp, Picornaviridae sp.
  rodent/Mc/PicoV/Tibet2015 polyprotein gene,1
tttaaaagagcctgggggttgttcccacccccaggatgcccactcgtgggcatgtggtactgtggtatcgcggtaccacagtacgcctctttgaccgccctgacccaagaatcttttcctttaacagatctcttcgtaacaagggcctcagcctgacgcaagtgcctccattggagtctctccaagccctccggggcttggagggcgccgaccccctgcctagggggagcccacgacacggctggagtccattggcacaccgcagccacgattcaagccagaattgaaagcgggaagcacttctgtctccccggtgtggatcatacgctgtacccacggcgaaaagtgaagcatcgttacccgactcggtacttcgagaagcccagtacagttgtggatctctgcagggtatacgctcagcgtgacccctacgtagttccttgagatggctgagagaacaccccacgggcgaccgtgtctctcggcgcgtggctcaaggccgggccttcagtggctcggtgccttgcagagtgaagcctccgaacagcctattgagctaccgtttagcctccgccctcttgaatgcggctaatcctaaccatggagcgcccgcccacagtccagtgggtagagcgtcgtaacgcgcaagtccgtggcggaaccgactactttagagtggcgtgtttccaatttatcctttataaagttgcttatggtgacaccacaagagatccacgatttcttgtttcttatcactgagacacaagtcatattcatcaatctttattgcggaattaacttggtgcgtccaaacacatcagc

SEQ ID NO: 1277 - DNA, 822 bp, Bovine enterovirus type 2
  strain BHM26, complete genome.1
tttaaaacagcctgggggttgtacccacccccggggcccacgtggcgccagtactctggtacgctagtacccttgtacgcctgtttttcccccccttaaataaattaagactgccactactgaggggagtagtccgactccgctccggcactgccgcaccagtacactggtatgttagtacctttgtacggagtaagtggtatccccaccctgaaacttagaagtatgcaaacaaaccgaccaataggtgcgcggtatccaaccgcgtaacggtcaagcacttctgtctccccggtccgaaaggatcgttatccgcccgacccactacgagaagcccagtagctggccaagtgaacgcgaggttgcgctcagccacaaaccccagtggtagctctggaagatggggctcgcacttcccccgtggtgacacggttgcttgcccgcgtgtgcttccgggttcggactcgtgccgatcacctcaaattcacgcaaccagtcaagagcctattgtgctgggacggttttcctccggagccgtgaatgctgctaatcctaacctccgagcgtgtgcgcacaatccagtgttgctacgtcgtaacgcgtaagttggaggcggaacagactactttcggtactccgtgtttcctttgaattttatcattattttatggtgacaattgctgaaatctgtgatttggcaactctcccactgaacatcgcactatactacctgattgcatttcacaaaacctccgatatccccagttcctatatcgacctacttgtttatctcaatttgaaacataaactaggacggttgaa

SEQ ID NO: 1278 - DNA, 822 bp, Enterovirus F
  strain IL/alpaca, complete genome.1
tttaaaagagcctgggggttgtacccacccctggggcccacgtggcgctagtactctggtacgccagtacctttgtacgcctgttttcccctcccttaaataaattaagattgccactactgaggggagtagtccgactccgctccagcaatgctgcaccagtgcactggtacgccagtaccttttcacggagtagatggcatccccaccccgaaacgtagaagcatgcaaacaaaccgaccaccaggcgcgcggcatccaaccgcgttacggtcaagcacttctgtttccccggtccgcaaggatcgttacccgcccgacccactacgagaagcccagtaactggccaagtggtcgcgaggttgcactcagccacaaccccagtggtagctctggaagatggggctcgcagttcccccgtggtaacacggttgcctgcccgcgcgtgcttccgggttcggctctcgccgttcacctcaaccccacgtaaccagccaagagcctattgtgctgggacggtattcctccggggccgtgaatgctgctaatcccaacctccgagcgtgtgcgcacaatccagtgttgctacgtcgtaatgcgtaagttggaggcggaacagactactttcggtaccccgtgtttcctttatttttccttcaaaaattttatggtgacaattgttgagatttgcgatttggccactttaccattgaatattgccttgtattacttggttgcttttcacagaacctctgacatacccagttcgtatattgatcttcttgtttatttaaacctaaaacacaaacttagaaagctaag

SEQ ID NO: 1279 - DNA, 822 bp, Enterovirus F
  strain BEV-261 polyprotein gene, complete cds.1
tttaaacagcctgggggttgttcccacccctggggcccacgtggcgctagtactctggtacgctagtacctttgtacgcctgtttttcccctcccttaaataaatcaaggttgccactactgaggggagtagtccgactccgctccagcaatgctgcaccagtgcactggtacgctagtaccttttcacggagtagatggtatcccttaccccggaacctagaagattgcacacaaaccgaccaataggcgcaccgcatccagccgtgcagcggtcaagcacttctgtctccccggtctgtaaagatcgttatccgcccgacccactacgaaaagcctagtaactggccaagtgaacgcgaagttgcgctccgccacaaccccagtggtagctctggaagatggggctcgcaccacccccgtggtaacacggttgcctgcccgcgtgtgcttccgggttcggtctcgtgccgttcacttcaacttcacgcaaccagccaagagcctattgtgctgggacggttttcctccggggccgtgaatgctgctaatcccaacctccgagcgtgtgcgcacaatccagtgttgctacgtcgtaacgcgtaagttggaggcggaacagactactttcggtaccccgtgtttcctctcattttatttaatattttatggtgacaattgttgagatttgcgctcttgcaacgttgccattgaatattggcttatactatttggttgccttttacaaaacctctgatatacccagttcttacattgatctgcttgtttttctcaatttgaagtatagactacaaatagcaaa

SEQ ID NO: 1280 - DNA, 822 bp, Enterovirus F
  strain PS87/Belfast polyprotein gene, complete cds.1
tttaaaacagcctgggggttgtacccacccctagggcccacgtggcgccagtactctggtacattagtacctttgtacgcctgttttcccctcccttaaataaatcaagattaccactactgaggggagtagtccgactccgctccagcaatgctgcaccagtgcactggtacgctagtaccttttcacggagtagatggtatccccaccccgaaacttagaagcatgtgatcaaatcgaccaataggcgcgcggttgccagccgcgtttcggtcaagcacttctgtttccccggtccgcaaggatcgttacccgcccgacccactgcgagaagcccagtaactggccaagcggtagcgaggttgcactcagccacaaccccagtggtagctctggaagatggggctcgcagttcccccgtggtaacacggatgcctgcccgcgtgtgcttccgggttcggtctcgtgccgttcacctcaataccgcgtaaccagtgaagagcctattgcgctgggacggttttcctccggggccgtgaatgctgctaatcctaacctctgagcgtgtgcgcacaatccagtgttgctacgtcgtaacgcgtaagtcaggggcggaacagactactttcggtaccccgtgtttccttttattttatatttatcattttatggtgacaattgctgagatttgcgatttagcggttttgccattgaacattgctttgtactacttggttgcatttcacaaaacctccgacatacccagctcctacatcgacttgcttgtttttcttaattaagacataaactagagaacacaaa

SEQ ID NO: 1281 - DNA, 822 bp, Enterovirus F
  genomic RNA, complete genome,strain: BEV IS2/Bos1
ttaaaacagcctgggggttgtacccacccctggggcccacgtggcgccagtactctggttcgcttagaacctttgtacgcctgttttcccctcccttaaacaaattaagattgccactactgaggggagtagtccgactccgctccagcactgctgcaccagtgaattggtacgctagtacctctccacggagtagataggaatccctacccgaaacttagaagcatgtaaataacccgaccaataggagcgtggtatccaaccatgttaaggtcaagcacttctgtttccccggccagaaatggtcgttacccgccctacccactacgagaagcccagtaactacccaaacaagtgagaagttgcactcatccacaaccccagtggtagctctgagagatggggctcgcatcttcccccgtggtaacacggttgcttgcccgcgtgtgctctcgggttcgaccccgtgtcgatcacctccgatctgacgtaaccagccaagagcctattgtgctgggaaggttttcctccggagccgtgaatgctgctaatcccaacctccgagcgcgtgcgcacaatccagtgttgctgcgtcgtaatgcgtaagttggaggcggaacagactactttcggtactccgtgtttccttttattcatttattgattttatggtgacattgctgagatttgtgatttggctgttttaccactgaacattgccctgtattacctgattgcattccacaaaacttctgagatacctacatcttatattgatttacttgtcttccttaacctgaggcacaaactagagaacacaaa

SEQ ID NO: 1282 - DNA, 823 bp, Bovine enterovirus type 2
  strain BJ001, complete genome.1
tttaaaagagtcagggggttgtacccacccctggggcccacgtggcgctagtactctggtacgttagtacccttgtacgcctgtttttccctcccttaaataaattaagactaccactactgaggggagtagtccgactccgctccggcactgccgcaccagtacaccggtacgctagtacccttgtacggagtagatggtatccccacccccgaaacttagaagcaagcacacaaaccgaccattaggcgcgcggcatccagtcgcgtaacggtcaagcacttctgtttccccggtccgcaaggatcgttacccgcccgacccactacgagaagcctagtagttggccaagtgaacgcgaggttgcgctcagccacaaccccagtggtagctctggaagatggggctcgcacttcccccgtggtaacacggttgcttgcccgcgcgtgcttccgggttcggcttcgtgccgttcacctcaacttcacgtaaccagcaaagagcctattgtgctgggacggttttcctccggggccgtgaatgctgctaatcccaacctccgagcgtgtgcgcacaatccagtgttgctacgtcgtaacgcgtaagttggaggcggaacagactactttcggtaccccgtgtttccttttaattttattcattattttatggtgacaattgctgagatttgtgatttggcgactttaccattgaatattgcattctattaccttatagcatttcacaaaacttctgatattccaccctcctacatcgacctgcttgttttcctgaatctcaaatataaatttgaagagacaaa

SEQ ID NO: 1283 - DNA, 828 bp, Rosavirus 2
  strain GA7403, complete genome.1
ttttcaaagccggggttgggggggctgcaccccatccccccttcttcccctcttcctccgttgcgcgcgttcctgacgcccgccgcggagttcctagctggctaacacccagttgggagggctctcactccctcacacctcgcgctttggacgccaggcatggcgttaaacatgcattcccttcccctagtaacctcccttcgccccttccccacgttgtaccccctccgagatggctgctaaggcgcttgctgctacagcagtctcgtgtttcgggtgttataagtgctttcttttccactccactccctgcctatggggagcggaacggccttgtctcggtcgttgcttcttgcagatcttcacccctccaggctttctggactcgccaggggtggagtagtaggcgcactgtctaagtgaaggtagcagtgttgttggcgaagagttgtggacctactttgagtttgtagcgatcatccagagctagcggatctccccacgcggtaacgcgtgcctctaggcccaaaaggcacggtgttcacagcaccctttggatggcgggggtgcccccctccgcacttaaagtagaaaaacagcttagtagtcaaataacatggctttcctcaagcattcagtgctacatgggactgaaggatgcccagaaggtacccgcaggcaacgataagctcactgtggatctgatctggggccctgggccaggtgctatacacctggttaaaaccaaatctggtagtcagggttaaaaaacgtctaagtcccacccccccggggacggggggttcccttaaaccctcaactgacacc

SEQ ID NO: 1284 - DNA, 830 bp, Rattus tanezumi hunnivirus
  strain Wencheng-Rt38-2 polyprotein gene,1
cccccctcccccccttcccttccctttgcaacgcaacaattgtaagtgccctcacctgtcaattgggaccaccactttcagtgaccccatgcgaagtgctgagagaaaggaagctttcttacccttcatttgtgaacccactggtctaagccgcttggaatacgatgagtggaaaagttcattcttaatggagtgaaacatgcttaaatttccagctcgtgctggtctttccagtacggggcggccctgtctggccgtaattcttcagagtgtcacgccacacttgtggatctcacgtgccacatgacagcgctacagctggaactgggtgcttggtgcccatggagtaacagcgaaaagtgttagatcaagccttgcttgggctatgagcctgcggaacaacaactggtaacagttgcctcaggggccgaaagccacggtgttaacagcaccctcatagtttgatccacctcagggtggtgatgtttagcagttagtagttgccaatctgtgttcactgaaatctcggcataccgtgtagtgtacaggggtgaaggatgcccagaaggtacccgtaggtaaccttaagagactatggatctgatctggggccttgtccggagtgctttacacacggctcaaggttaaaaaacgtctagccccacagagcccgagggattcgggttttccctttaaaaacccgactagagcttatggtgacaattattgctgttcagacgaacagtgtaattgttgtctattcacagcagttctatcagagcttttcccacaacggatcttcttggcaagcaaatacagcaggagtcaat

SEQ ID NO: 1285 - DNA, 837 bp, Enterovirus E
  genomic RNA, nearly complete genome,strain:1
atttaaggaggggaaaacagcctgggggttgtacccacccctggggcccacgtggcgctagtactctggtacgttagtacctttgtacgcctgttttcccctccttaaataaattaagattaccactactgaggggagtagtccgactccgctccagcaatgctgcaccagtgaattggtacgctagtacctctgcacggagtagatggtatccctttccccgaaacttagaagaaagcaaacaaaccgaccaataggagcgcggcaaccagccgtgttgcggtcaagcacttctgtttccccggtccgcaaggatcgttatccgcccgacccactacggaaagcctagtaactggccaaacagcaaagaagttgcgctcggccacaaccccagtggtagctctggaggatggggctcgcatctcccccgtggtaacacggttgcttgcccgcgtgtgcctccgggttcagtcatcgactgttcacttcaatgctgtgtaaccagccaagagcctactgtgctgggacggttttcctccggggccgtgaatgctgctaatcccaacctccgagcgtgtgcgcacaaaccagtgttgctacgtcgtaacgcgtaagtcggaggcggaacagactactttcggtaccccgtgtttcctttgatttttatttaatattttatggtgacaattactgagatttgtgatttggctgctttaccattgaatattgctctgtactatttagtcgcatttcacaaaacttctgagatccctgcgtcttttattgacttgcttgttttcctcaatttgaagtgcaaactagaaggcataaaaagag

SEQ ID NO: 1286 - DNA, 843 bp, Washington bat picornavirus
  polyprotein gene, complete cds.1
cctatcgacagagtttgttgccgttaaaaagaggtcccaggggtgtttcccctggggcccctttttaacggcaacaaactctgtcgataggctaacgccgagcgttcacttagtgagggcgatttacatcacataacaccgccttgtttgacatgtttcactcaaggacaagatatggtaaatctgtgcactacttgaaaattctcgacgttagcggagctaaaacaacaccacaacacaacacaacaattaacaacacattagaaattcgaatttagaagttagaccccaatttttgatttaacatctgttattttgactttgggcaatccactgatctttgaatttcacacgacagccgtggagagacggcacacgctacttcagcatagatccaaggatagctggtagcggcgacgaagtccacaatcactctatattttcaggcttctgaaagtgctgataaattgattaagttcggtttatcggaattgccgaggtccctcgaagaaacccgcggaaatgagaatatagatgttggtatggcagccagaagacatgaactatgacaagtacgtacgagcgtgtgttcggacctggttccccgccttaggatcagcgccctgtgaggggaccctttggaaagatgatcactacatagactactcgaacgagaaactatgcaaataacagggaacgtttggccacccggatgaatccagtagtacggaaaagcttaggaattcgattttggatcttttacctgtgttttaataagaaatgcaggagttgataaatagggctcgactgggagcgagactgcagcggctaaagcagcagtaa

SEQ ID NO: 1287 - DNA, 847 bp, Dromedary camel enterovirus
  strain 20CC, complete genome.1
ttaaaacagcctgggggttgttcccacccccagggcccacgtggcgcaagtactctgcttcgttagaagccttgtacgcctgttttcccctccttaaataaattaagattaccacttccgaggggagtagtccgactccgctccgatacgtcgctccagtgcgctagtacgcttagtactttctcacggggatagtggtacccctccctagtaatttagaagacttgaaaaaccgaccaataggcacctcgcatccagcggggtaaaggtcaagcacttctgtttccccgggtcgagtagcgatagactgtgcccacggtcgaaggtgaaacaacccgttatccgactttgtacttcgggaagcctagtaccaccaaagattatgcttggggtttcgctcagcacgaccctggtgtagatcaggctgatggatcaccgcgttcctcacaggcgactgtggcggtggtcgcgtggcagcctgccgatggggcaacccatcggacgccaagcatatgacagggtgtgaagagcctactgagctacaaagtattcctccggcccctgaatgcggctaatcccaaccacggagcatttgctaccaaaccaggtagtggaatgtcgtaacgggtaactctgtggcggaaccgactactttgggtgtccgtgtttccttttaatttatcattctgtgtatggtgacaactatagtgctatctcgatttgcattactattgttgagattgacactttattacattgttgcattttaccctttgagtgagttttcacctgaacagattaatttacttatcctgtttatatatcacaagcagaaatacttgcaaag

SEQ ID NO: 1288 - DNA, 867 bp, Falcon picornavirus
  complete genome.1
tttgcgcgcgggacctctgctacggccgggctcatattatcctccggggttttatgggtcgggcctagcccctttctgtaacggtctgtgtgagacctaaaaccacacataatatcgtgcctgatggttaacgcttgttagccgtctgtaaactaagaacctaccaacacactatgcacctcttggcgaagccgcttggaataagttgagaggaattatgcatgctagttgtgtttgtttacaactaattgttctaatccaagtgaagctcttcgcttggggcggcacgacacttgccgtaattcttctaccgtccctccacaccttgtggatgaagggccggatgtgtggcctctggctaacccctctctctggggtgatgctactggatgttttactcctagaccaaatcacatgaactcctcttgatccacttcggtggggctatgagcctgcggattaatagctggcgacagctaccccaggggccaaaagccacggtgttagcagcaccctcatagtctgatgcccaagggctgatgttgggagctagtagtgtgtgtctggcctatgtttaggacttctggccaagcgcagaggagtggggctgaaggatgcccagaaggtacccgtaggtaaccttaagagactatggatctgatctggggccccctcacgtggctttaccacgtgttgggggttaaaaaacgtctaggccccaccagcccacgggagtgggctttcccttaaaaagcccaacaatatttatggtgacaattcactgtttcttctttgcaatttttgtattcttggactccttattttttgtttgcttgattttagtggacattcagattcaaatacaaa

SEQ ID NO: 1289 - DNA, 891 bp, Antarctic picorna-like virus 3
  nonstructural protein gene, complete1
aagttgcattattaggtgcaaccataattgtttattttttcccgtgtgagacggaattctcatgacagggcagtcgagagagagcgatctctctctttgcctctaatagcaatattagcgttaccctttttcgataaaagagaaatatcaaaacgatagtagacgaaagttaatctatgtcctacatttgtagggaatgaaatactgattagttgtcattgacgacagatctaagctgtaatcaacagccggacttgtgcaaagttcgataagtagaataagtactagagattagtggatttgtgacccacaacttgaattaaaggcttgtatgtgcggaaatgctgtacaagaaaagagctaaaatgcgttttcctacgtgacgatataaacgatggaggtggggttcacttatttggagaaccgacctagacggctgtttttaacagcacccccagttgcctttctgggcttagtttcgggaataggaccccgaaacggcgtacgccactaaaaaggagaagacgtcaagcagcatgcgattaggacatgtatgtgtttttatccgattatggaaccaggtggttccgtaattgagacatatacccctatatttaaggtgtcgaaagatacccattatatgcaattactggagtattttgtatatatgtgctgtgagggcactatcctaggttaccgtgggatcgcaagatcaccttacggactgagcagtaaaagccattttggccgtctcttagcgtagagcacacactcatgcgaaacccaaactcgaaagagcgggctagtaggacttagggcagattgatgatcaaagaccccccaaaaggtctttttctctttctgcgtcttcatcttcctcatatgttttag

SEQ ID NO: 1290 - DNA, 899 bp, Equine rhinitis B virus
  strain 421, complete genome.1
ttttgtaactgaggttttaacatctcattgtttttgagccccaacgtcttggtggatgctcaaaagagattactcttgatgcttggctctcagaaagaatggcacctcaacgtgttgagacccgattcttttgagtcgagaccacttcccctcacccttaagattgcttttcttccaactaaacccctattgatgtgttggtcgtttgccaatcggagggcgacagatgcaggtcgctctgaggtctagtagtgtgggaacttgtcgctactaatgaaacgaggtagtgacacttagtacctacgaacaaatcttggagcaactccctttgcttccttcacccatctttcacttttcgttccgctttagcaggggtcttctttctgtccccctggcggcattggaactagccgtcgcgccttagcgcgcagccctgaaggccccacatcttgtggatctcgccgtgggcatgtttccggcatgtgtttctcaagcctgcaaccgaagaccgaacagccacttgaacggtttgagcgtggtagcgctgtgcgagttggcggtggactcccctcgtggcgacacgagcccccgcggccaaaagcccagtgtttgcagcacctctcgcatccaggacaaccccatcctggcgctcactcttagtagtgtggcttagtacgtattaggtggtaagccgagctctccctcggtcttgttctgaatgcacacatgtctaggggctaaggatgtcctacaggtacccgcacgtaaccttaagagagtgtggatctgagtaggagaccgtggtgcactgctttacagttgtagcccggtttaaaaaacgtctatgcccctacagggtagcggtgggccgcgccctttcctttaaaaatatttgtttt

SEQ ID NO: 1291 - DNA, 899 bp, Pacific black duck sicinivirus-like virus
  isolate1
ttacacgcgagttttgcctcgcgcgcccgtaagggcacaaacccccctaggacgtgcacttgcccattggtacgtccggaaaccgtctgcctcggcacgcggcttctccacggtcgcaagcgacccacaatgcttcctggccatggtgtcccccaggaagagcgaacttgtggtgcggcgacccgggagtcgcgtcggcagctcaagtttctctggcagcacaccattttcccctttgtaacctcccgaaaatggcccgggggtagtccgccccctcaaaatggaccgtgtgcacccctccccacgcgttaaagcgggaagggccctcagtcggcgcagggaagcgcgctgaccctgttaagtggataggtcaggaaaaacatgtccacatcataaccccaattcccacggtcgctgatggtctgaccgttaggggcggcccaccggcgctctttgccgggcgtggcttaaccacaccatctcctctagtggattcctagagttctcccacttagtaagctcattccccccactgctgatcccgcaagggagtacaagtgcccagtgagcccacctggtaacaggtgcactggggcccaaaaggctagtggacagggggaagaccccgaatgccgtgggttcccacctgcggtgaagggtttcccccgaagtccacctttgtacttggctatggcctgttggtagtgtggagagtggcgccgaaaggtctggatgtactctctgaggaaactagtaggatcggagaacgttagtagacccccactaggtacccgcgcaagcggatctgaggtgggcccggtgactatgccgttccggtaagtccgggttaaaacaatgaacgcgttctccacaaatcactttcctctctttcttattca

SEQ ID NO: 1292 - DNA, 900 bp, Equine rhinitis B virus
  strain 396, complete genome.1
ttttgtaactgaggttttgacatctcattgtttttgagccccaacgtcttggtggatgctcaaagaagattactcttgatgcttggctctcagaaagaatggcacctcaatgacttgagacccgattcttttgagtcgagacctttttccctctccccttttgaagattgctttcttccaactaaacccctattgatgtgttggtcgtttgccaatcggagggcgacaggcacaggtcgctcctgagctcagtagtgtgggaacttgttgctactaatgaaacgaggtagtgacacttagtacctgcgaacgactcaggtgcaatccctgtacttctttcaccaaccttccactttccgttccactttagcaggggtcttctttctgtccccctggcggcattggaactagccgttgcgccttagcgcacagccctgaaggccccacaccttgtggatcttgccgtgggcatgtttctggcatgtgtttctcaagcctgtaaccgacgaccgaacggtcacgtgaacagtttgagcgtggtagcgctgtgtgagttggcggtggactcccctcgtggcaacacgagcccccgtggccaaaagcccagtgtttgcagcacctctcacatccagggaaaccccaccctggcgctcactcttagtaacgtggcttagtacgtattaggtggtaagccgagctctccctcggtcttgtactgaatgcacacatgtctaggggctaaggatgtcctacaggtacccgtacgtaacctttagagagtatggatctgagtaggagaccgtggtgcactgctatacagatgtagcccggtttaaaaagcgtctatgcccctacagggtagcggtgggccgcgccctttcctttttaaaacttgttttt

SEQ ID NO: 1293 - DNA, 904 bp, Equine rhinitis B virus 2
  strain 1228, complete genome.1
tatccccttgatgcaactgaggttttaacatctcattgtttttgagccccaacgtcttggtggatgctcaaagaagattactcttgatgcttggctctcagaaagaatggcacctcaacacttttgagacccgattcttttgagtcgagaccacttcccttcccctcaaggattgcttttcttccaactaaacccctattgatgtgttggtcgtttgccaatcggagggcgacagatacaggtcgctttggcgcttggtagtgtgggaacttgtcgctgctgatgaaacgaggtagtgacacttagtacctacgagaggcaacaaggcaataccccatcttccttcaccaactttttcttttcgttccactttagcggaggtcttctttctgtccctccggcggcattggaactagccgttgtgcctcagcacacagccctgaaggctccacaccttgtggatcttgccgtgggcatgtttctggcatgtgtttctcaagcctgcaaccgaagaccgaaccgttgcatgaacagtttgagcgtggtagcgctgtgcgagttggcggtggattcccctcgcggcaacacgagcccccgcggccaaaagcccagtgttcacagcacctctcgcatccaggaaaaccccctcctggcgctcactcttagtagtgtgacctagtacgtactaggtggtaagccgagctctccctcggtcttgttctgaatgcacacatgtctaggggctaaggatgtcctacaggtacccgtacgtaaccttcagagagtatggatctgagtaggagaccgtggtgcgctgctttacagtcgtagcccggtttaaaaagcgtctatgcccctacagggtagcggtgggccgcaccctttcctttgaaactattgtttt

SEQ ID NO: 1294 - DNA, 905 bp, Equine rhinovirus 3
  strain P313/75, complete genome.1
tatccccttgatgcaactgaggttttaacatctcattgtttttgagccccaacgccttggtggatgctcaaagaagattactcttgatgcttggctctcagaaagaatggcacctcaaagttttgagacccgattcttttgagtcgagaaccttacccccaacccttgagattgcttttcttccaactaaacccctattgatgtgttggtcgtttgccaatcggagggcgacaggcgcaggtcgccccaacagctagtattgtgggaacttgccactgctgatgaaacgaggtagtggcatttagtacctgagaacgctggaggagcatctccccctcttccttcattaatctttcacttttcgttcctctttagcgggggtcttcttgctatccccccggcggcattggaactagccgttgcgccttagcgcacagtcctgaaggccccacatcttgtggatcttgccgtggacatgtttctggcatgtgtttctcaagcctgcaaccgacgactgaacagacgtgtgaacagtttgagtgtggtagcgctgtgtgagttggcggtggaaccccctcgtggtgacacgagcccccgtggccaaaagcccagtgtttacagcacctctcacatccagggaaaccccaccctggcgctcactcttagtaacacttcctagtaggtattaggtggtaagccgagctcttcctcggtcttgttctgaatgcacacatgtctaggggctaaggatgtcctacaggtacccgcacgtaaccttcagagagtgtggatctgagtaggagactgtggtgcgctgctttacagacgtagcccagtttaaaaaacgtctatgcccctacagggtcgcggtgggccgcaccctttccttttacaaacttggtttt

SEQ ID NO: 1295 - DNA, 906 bp, Sicinivirus sp.
  strain RS/BR/2015/4S polyprotein gene, complete1
gttgcgtgcctgcagccgctcagcgtccatccttcctgttacccacctaatttggtggtaccccccggtcccttccctatccccccatacagccggaacggaccacacacctccgggtctgtggcccaaccccgactcggggttgtggcggtggtcacagctccggctgtgacttcctaaccactcctttcacccacccctttcttacatctacttaagtttatgtttgccctctcatcccaaggccttggctcatgtcctttgaggctatctggcacaaacactctttgtttggcgtctggagacccactgagccaccacttatccatgctcaatgcaacccccattagtaaccacgcaaatctaatagtggttctgcctcggcagcacctaagtgcccagggagttcaactggcgacagttgccctggggcccaaaaggctaggtggtaagggtctggccaagcaaggggtccccaccccaagctgaacccatggccccgaagccaccctttaggtggaggttatgtacccgatcgctattctatttgtttggcgaacctggccggaaacatttagtttgtggattcgttggtttgtggtgattagtagaccccctggaggtacccgttttggatctgaccagggacccgtgactataccgctccggtaattcgggtttaaaaccatgaacgtcaccacttgtcttcttttcccattttattcttcttatagtggtctgtttaaatgctcttagaatttctgttggtgactacggcacttaccatagtggttctttcccccagtgagttgcatcagctgcttgctatttgcgtgtataattttgcattaattttcctctggttgctcggaattttggagttgcctagttaccccgctatacagc

SEQ ID NO: 1296 - DNA, 915 bp, Coxsackievirus
  A16, strain S1082b polyprotein gene, complete cds.1
caggaacattcattagacgccatcagatccgtctcagggaaaagatcggtcgttgatctcctttctatgagacttcatgaagcgagggtttgtagttcgaagtggcatcagacacctcatggggttccgagaacttaattgggggacaaaagtgtacaaaaaagcaggctttaaaacagctctggggttgttcccacccacagggcccactgggcgctagcacactgattctgcgggatctttgtgcgcctgttttataaccctccccctaagcagcaacttagaagctctgtacaatcacgaccagtagtgggcgtggcgcgccagccatgtcttggtcaagcacttctgtatccccggactgagtatcaatagactgcttacgtggtcgaaggagaaaacgttcgttacccggctaactacttcgagaaacccagtagcactatgaaagttgcggagtgtttcgctcagcacttcccccgtgtagatcaggtcgatgagtcactgtaaaccccacgggcaaccgtgacagtggctgcgttggcggcctgcccatggggtaacccatgggacgctctaatacagacatggtgtgaagagtctattgagctagttagtagtcctccggcccctgaatgcggctaatcctaactgcggagcgcgcaccctcaacccagggggcggcgcgtcgtaatgggtaactctgcagcggaaccgactactttgggtgtccgtgtttccttttattccttattggctgcttatggtgacaattgagaagttgttaccatatagctattggattggccatccggtgtctaacagagccattgtttacctattcattggatacgtccctcttgatctcaaggccattcaaactcttgactatatattgctccttaactgcaagaa

SEQ ID NO: 1297 - DNA, 934 bp, Picornaviridae sp.
  isolate zftwig05pic3 genomic sequence.1
ccgtgggaccggagatgtgtgtccgaaaggtggcccgtttcgtgggccagacgttgaaagggggatgcagggtatgctgttttaatacagcaaagacccacacatccccgctttcaacgtctggcccacgaaacgggccacctttcggactgaccattggtttattattgaaattggcttggaaatgctgacactgtaagctggtttgtgatttaaacaatggttgttctggactctctttgagagatttacctggtggcttggcacagcctccttaaggacgtctggtccagaaaggcccggtcaagacttatattggactggtcccctgtccactgagtattctgttctgaaccgtgtaggcagggctagcgccaccatgattgccaagggactgcctccctggtgacagggacccttgggcccaaaaggctaggtggcaactctcatgtcaagagaggggtatccaccccaatctgaatcatgtggagtgaagccactcgtcatggctctgaccccgagactgtctacatttagtaagatggatgaaaactggatttggagaccactttgattgtcttgatgagaaagtccgctatttgactgagtagatgccctccagctacccttacggatgtgaggaggggaccgtgactatagcgttccgctaaaccggtttaaaaaacatgaaaggtcaaatatgtggcgccattttccatttttactaataaccatatgcctgacgaagttgattgtgctgagtgctctaagccctcctggactgtcagattaaaattggcttttctgcaatattttggctgccagtttgtatgggtttatcactcaggaaagaatcaagagaaagattgaaaatcttggattgtgcaaccaaggctcatttttgtccttgtgaaggcaaccagagattgcagtc

SEQ ID NO: 1298 - DNA, 944 bp, Mus musculus picornavirus
  strain Wencheng-Mm283 polyprotein gene,1
accccggtaaaggtcagggtgtacttgcccacgttggtcggcttgtcaacactggttccggctttatcctgatacgtcaccgtgtactcgctgccatcgatcacaaacccctcatcgtccttgacagtgaccgcaggctcctgcttctctccgttgaacgtcaccgagggcggcgtcacctggatggtgggcgcggtcacggtgttgctgatgatggacgcatctaccgaagcaggtgtgctgtcattgtggttgctgtcgccctgggccttgtaccagacagtgtaattgtccacagctttcccggtgggaatggttggagtatacgggccgtcctcagccagagcgtagaccatcgtgccgtcggaagcggtgcccgcctcaatcagcgcctgctcggtgccgttgtagggcagattttccaaacccttcggagccgttgccaccgatgcagcacccttcgcaatcacaaaggtccccgtaccgtttacgatgtagttgccgccgttggcgttggtgatgatgaccgtcgccgtaccggcgttgatgttgtcgcggtaggacagggtgtactcgtcgctggggatggtgttgccgccgtcctccaccttactgcgagactcctagtagggagtggacgtattttgtgtgtgacccggagtttcccccgctccagaaacctgtgatgagctatcctcacgcccacctggcaacaggcgaggacgctgcgttggcacaggacctcattgaggctcacaacttgctgaagcaaacgaagagacgattgcgctaaggtggtttcctccggcctcctgaatgcggctaatcccatcccttggtcatccgcccactagccagtgggtagggtgtcgtaacgcgcaagccgagggcggaaccgactactttggagtgtccgtgtttctattttattttatacggcagtc

SEQ ID NO: 1299 - DNA, 957 bp, Foot-and-mouth disease virus
  type SAT 1,isolate1
ctgtctgcctaatggaggtacgacagccagaggtctagccccagcgtcgcgtaacgaccgtccccggttgaaacgccactactcagacctctggctgtcgtacctccattaggcagacaggaaccacccttctggggcctacgctactgtgcccttttggggcccgcggtcgtcatcaccgcgcctccattaggctcgcagtcgtacctcctctaggctgacaactgtcgcccttttagggcctacgaccttcaagttacggttttggcgtccctcccgcggccgactcgcctacgtgaacgctagctcttcacccgaaggcccgcctttacgttaccgtcttttccgacgttaaaggattgcaaccacacgatttgccttcttttccgaagtaaaaggatacaagcacacagttttgcccgttttcatgagaaatgggacgtctgcgcacgaaacgcgctgttgctcttcgcattcttgtacaaacacgatcttgacgcaggaatcttagaccaacccaacccgtgcacctgcaagtttcgcccggtccttccgggtcttgagagacaaacagatgtactgagatcaactccacgattggtctactagcgggtactagtaacactcactttgcttcgtagcggagcacatgagcggtgggacctcccccatggtaacatggacccaccgggccaaaagccacgcctcacggcctcatgtgtgtgcaaccccagcacggcaacttgtttgtgaaacacaccttaaggtaacactgagactggtacttgatttctggagacaggctaaggatgcccttcaggtaccccgaggtaacaagagacactcgggatctgagaaggggaccaggagttctatcaaactgcccggtttaaaaagcttctatgcctggataggtgaccggaggccggcaccttttcctttatttaaactcacttt

SEQ ID NO: 1300 - DNA, 966 bp, Canine picornavirus
  isolate A128thr polyprotein gene, complete cds.1
gggcctcctttcaccggggttcgcgtgacccggttataaaccacgtgacgtctttccagcgctgggttttgacgataaaataacccaggcactatagacagcgatgtctttaaacatccagacagaacagtctttaaaattacaagcttattcaattacaactagtggtgactcactttaaaatgtccaaatttaaggttggcagcttaactgcccgtgattgggctcacgtataaatggtcctggctggccgactacggccacacaatcaccgaatgatttaaacttcgggtgtgagctactaagctccttgtgtaagggtgacaccttgcccaagtatcttgtccccggtctgttgccgcttggaggcagatagggttattttccttgttactttctactcattggggatctatcccagtgaagggtcaagtggcaacccctctcttcttgaggagtggcatggcggtctttccgcatctcgaaccatgccacgcgccatgcacatatgtgacttataagtctgaagattttgaaacactttggttgacaagttgatgactgtagcgactccagtgtgcgagcggacttcccctcatggtaacatgagcctctcggaccaaaagtcaagcgttcatagcgccacactggacgggactttcctagtccctcatcaatgaaacacaatttgtgaatctttctttggacgaaagagtctgatgtgtaggatggagtgaagatggcctgaaggtaccccgtatacgggatctgatcaggtgcccctctcttggggttaaaaattactcggctcctcccacaaactggtggtccagtttttctctttaatttttactgcttatatggtgacagttattgacattctagtgttgattgcctattgttactttatattgttgttgtttttcctgaattgctttttacaaccttatactattacctttgaac

SEQ ID NO: 1301 - DNA, 970 bp, Ampivirus A1
  strain NEWT/2013/HUN, complete genome.1
ttaaaatgaaaatgtgcgagcatttagctcgcacttttcattttaaatatgtccacagccctcaagggacttagtcccttgtccgcctcggcgacttaatatttaacttgtagttacttatataaagcccgtaatttatacgatacatacaaaactccagcatccactctgactgccatagtggaataaaccaagaccactctctacatccggagagtcaaatccattggacgaccatttgatactattctacaaaatctattttgatcatattatattaagcattaagcgtcattgacttggttgattaattagtttcactgattaatcgagtcaacaaacaacttcctaaattaatataattttgctcaaacgagaatttcagaatattatgcgaccatttaactatgtttacttaagcatcattgacttttgagtcaacaaataccttaagtttccgctcatctccttaccttcatacgcaggcccataagcctatattatttacctctatttataattttaatcattaatctgcacaattccaccgtttagacattattagggtttataacaacactaataattattgtatgaaaaccagtagttccagcgcgtcgtggcctattgacccccatacaaagttcataagaatagttttgctgttttcagtcattcattctttcccttaaaaggtttggtcacctataagtccagctcattacatcgagtatggcaagtctgcccaacatttgttatatctgactctggtgataataaatgtggcgggataaagttacaagtctagttatatagacagctttagctcaaaaccccaatttccccccttgtgtattattattgtattattaattgtaattatgtatttaatgtaaattgtacttttatctatccaacttcttatttcaattttctatcaagacttttttcttgtcgaaactcaatatct

SEQ ID NO: 1302 - DNA, 975 bp, Carfax virus
  polyprotein gene, partial cds.1
cacggggttaacacctcgtgcgatcttttcaaccacatatatatatattctgggcggaatattagaaaatcttgggattatatatatgtaattgatatattgggcggaatatttgaaaatcttgatatatctcttacaaaattttgaaaccaaccattttagaataggtttattagcgtgacaaactatgcgacctgtagagaaaaatgtcaaaatcaatacaaaattttaaaatgttaaaaatgtttatatatttagtaaactcaagttgaattgtgatagagaaggcaagtaactaccagatgactcttctcgcaacaggattatcccagactgttgttccagcaaattgatggatgtaaactaaatttataatgataaatagttaagtaggagacccttatggtactcaagcttgtattaaaatttttaactatagatatgtattattgaaatgtgttctgtctcttatatgtacacccacgtagtcgtggtaccgctataacgccaatcggactaaataacaagaatgtgaggttcctattgagatttcaaaatttatcatattgtcacgaccaatctctttgggtaaggacttgcatggtatgcgaaaggtcggattgccagaatctgcttgctgctttctggatgtgtacacattttaattttaagatttatgatagttaatttgataatacaaggacagtgcgttttgtgacgtgcttgtttgcatctctgtcttagatgacaggtttctacactaggcgatgtgtagaagtgtagacctctaatggtttggtgcatcgtgccccggttctttttcaaggcttctccggttcaaagatagcggaggacccccctttgtaatgcagacaccattgtggataatttatctacaattcgaagcgataatttttccattcatttttgtatctttaaaacttcttacggagattttcaatattaactagaaaa

SEQ ID NO: 1303 - DNA, 723 bp, Unknown
  Description of Unknown: Expression vector pAV-UCSF, complete sequence.1 sequence
cctcggccccctcaccctcttttccggtggtctggtcccggaccaccgttactccattcagcttcttcggaacctgttcggaggaattaaacgggcacccatactccccccaccccccttttgtaactaagtatgtgtgctcgtgatcttgactcccacggaacggaccgatccgttggtgaacaaacagctaggtccacatcctcccttcccctgggagggcccccgccctcccacatcctccccccagcctgacgtatcacaggctgtgtgaagcccccgcgaaagctgctcacgtggcaattgtgggtccccccttcatcaagacaccaggtctttcctccttaaggctagccccggcgtgtgaattcacgttgggcaactagtggtgtcactgtgcgctcccaatctcggccgcggagtgctgttccccaagccaaacccctggcccttcactatgtgcctggcaagcatatctgagaaggtgttccgctgtggctgccaacctggtgacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccacctccgggtgggatctgagcctgggctaattgtctacgggtagtttcatttccaatccttttatgtcggagtc

SEQ ID NO: 1304 - DNA, 712 bp, Aichi virus
  genomic RNA, complete genome.1
tcaccctctttcccggtggtctggtcccggaccaccgttactccattcagcttcttcggaacctgttcggaggaattaaacgggcacccatactccccccacccccctttggtaactaagtatgtgtgctcgtgatcttggctcccacggagcggaccgatccgttggtgaacaaacagctaggtccacatcctcccttcccctgggagggcccccgccctcccacatcctccccccagcctgacgtatcacaggctgtgtgaagcccccgcgaaagctgctcacgtggcaattgtgggtccccccttcatcaagacaccaggtctttcctccttaaggctagccccggcgtgtgaattcacgttgggcaactagtggtgtcactgtgcgctcccaatctcggccgcggagtgctgttccccaagccaaacccctggcccttcactatgtgcctggcaagcatatctgagaaggtgttccgctgtggctgccaacctggtaacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccacctccgggtgggatctgagcctgggctaattgtctacgggtagtttcatttccaatccttttatgtcggagtc

SEQ ID NO: 1305 - DNA, 712 bp, Kobuvirus sp.
  strain 16317x87 polyprotein gene, complete cds.1
tcaccctcttttccggtggtctggtcccggaccaccgttactccattcagcttcttcggaacctgttcggaggaattaaacgggcacccatacacccccatcccctttctgcaacttaagtatgtgtgctcgtgatcttgactcccacggaatggatcgatccgctggagaacaaactgctagatccacatcctcccttcccctgggaggaccttggtcctcccacatcctccccccagcctgacgtaccacaggctgtgtgaagcccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatacctgagaaggtgttccgctgtggctgccagcctggtaacaggtgccccagtgtgcgtaaccttcttccgtcttcggacggtagtgattggttaagatttggtgtaaggtccatgtgccaacgccctgtgcgggatgaaacctctactgccctaggaatgccaggcaggtaccccacccccgggtgggatctgagcctgggctaattgtctacgggtagtttcatttccaattcttttatgtcggagtc

SEQ ID NO: 1306 - DNA, 712 bp, Aichi virus
  isolate Chshc7, complete genome.1
tcaccctctttcccggtggtctggtcccggaccaccgttactccattcagcttcttcggaacctgttcggaggaattaaacgggcacccatacatccccatcccctttctgtaacttaagtatgtgtgcttgtaatcttgactcccacggaatggatcgatccgctggagaacaaactgctagatccacatcctcccttcccctgggaggaccttggtcctcccacatcctccccccagcctgacgtaccacaggctgtgtgaagcccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtctccggacggtagtgattggttaagatttggtgtaaggttcatgtgccaacgccctgtgcgggatgaaatctctactgccctaggaatgccaggcaggtaccccaccctcgggtgggatctgagcctgggctaattgtctacgggtagtttcatttccaatccttttatgtcggagtc

SEQ ID NO: 1307 - DNA, 679 bp, Aichi virus
  strain kvgh99012632/2010 polyprotein gene, complete1
gtgttactccattcagcttcttcggaacctgttcggaggaattaaacgggcacccatactcccccccaccccccttttgtaactaagtatgtgtgctcgtgaccttgactcccacggaacggaccgatccgttggtgaacaaacagctaggtccacatcctcctttcccctgggagggtccccgccctcccacatcccccccccagcctgacgtgtcacaggctgtgtgaagcccccgcgaaagctgctcacgtggcaattgtgggtccccccttcatcaagacaccaggtctttcctccttaaggctagccccggcgtgtgaactcacgttgggcaactagtggtgtcactgtgcgctcccaatctcggccgcggagtgctgttccccaagccaaacccctggcccttcactatgtgcctggcaagcacacctgagaaggtgttccgctgtggctgccagcctggtaacaggtgccccagtgtgcgtaaccttcttccgtcttcggacggtggtgattggttaagatttggtgtaaggttcatgtgccaacgccctgtgcgggatgaaacctctactgccctaggaatgccaggcaggtaccccaccttcgggtgggatctgagcctgggctaattgtctacgggtggtttcatttccaattctttcatgtcggagtc

SEQ ID NO: 1308 - DNA, 727 bp, Aichi virus
  isolate Goiania/GO/03/01/Brazil, complete genome.1
ggcttcggccccctcaccctcttttccggtggtctggtcccggaccaccgttactccattcagcttcttcggaacctgttcggaggaattaaacgggcacccatacacccccatccccttttttgcaacttaagtatgtgtgctcgtaatcttgactcccacggaatggatcgatccgctggagaacaaactgctagatccacatcctccctcccccctgggaggacctcggtcctcccacatcctccccccagcctgacgtatcacaggctgtgtgaagcccccgcgaaagctgctcacgtggcaattgtgggtccccccttcatcaagacaccaggtctttcctccttaaggctagtcccgatgtgtgaattcacatcgggcaactagtggtgtcactgtgcgctcccaatctcggccgcggagtgctgttccccaagccaaacccctggcccttcactatgtgcctggcaagcatatctgagaaggcgttccgctgtggctgccagcctggtaacaggtgccccagtgtgcgtaaccttcttccgtccccggacggtagtgattggttaagacttggcgtaaggttcatgtgccaacgccctgtgcgggatgaaacctctactgccctaggaatgccaggcaggtaccccaccttcgggtgggatctgagcctgggctaattgtctacgggtagtttcatttctaattctttcatgtcggagtc

SEQ ID NO: 1309 - DNA, 710 bp, Aichi virus 1
  strain PAK56 polyprotein gene, complete cds.1
accctcttttccggtggtctggccccggaccaccgttactccattcagcttcttcggaacctgttcggaggaattaaacgggcacccatacacccccaccccctttctgcaacttaagtatgtgtgctcgtgatcttgactcccacggaatggatcgatccgctggagaacaaactgctagatccacatcctcccttcccttgggtggacctcggtcctcccacatcctccccccagcctgacgtatcacaggctgtgtgaagcccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccgaacccctggcccttcactatgtgcctggcaagcatatctgagaaggtgttccgctgtggctgccagcctggtaacaggtgccccagtgtgcgtaaccttcttccgtcctcggacggtagtgattggttaagatttggtgtaaggttcatgtgccaacgccctgtgcgggatgaaacctctactgccctaggaatgccaggcaggtaccccaccctcgggtgggatctgagcctgggctaattgtctacgggtagtttcatttccaattctttcatgtcggagtc

SEQ ID NO: 1310 - DNA, 710 bp, Aichi virus 1
  isolate ETH/2016/P4, partial genome.1
accctcttttccggtggtctggtcccggaccaccgttactccattcagcttcttcggaacctgttcggaggaattaaacgggcacccatacacccccaccccctttttgcaacttaagtatgtgtgctcgtgatcttgactcccacggaatggatcgatccgctggagaacaaactgctagatccacatcctcccttcccttgggaggacctcggtcctcccacatcctccccccagcctgacgtaccacaggctgtgtgaagcccccgcgaaagccgctcacgtggcaattgtgggtccccccttcattaagacaccaggtctttcctccttaaggctagtcccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtcttcggacggtagtgattggttaagatttggcgtaaggttcatgtgccaacgccctgtgcgggatgaaacctctactaccctaggaatgccaggcaggtaccccaccctcgggtgggatctgagcctgggctaattgtctacgggtagtttcatttccaattcttctatgtcggagtc

SEQ ID NO: 1311 - DNA, 710 bp, Aichi virus 1
  strain PAK585 polyprotein gene, complete cds.1
accctctttcccggtggtctggtcccggaccaccgttactccattcagcttcttcggaacctgttcggaggaattaaacgggcacccatacactcccatcccctttctgcaacttaagtatgtgtgctcgtgatcttgactcccacggaatggatcgatccgctggagaacaaactgctagatccacatcctcccttcccttgggtggacctcggtcctcccacatcctccccccagcctgacgtatcacaggctgtgtgaagcccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccgaacccctggcccttcactatgtgcctggcaagcatatctgagaaggtgttccgctgtggctgccagcctggtaacaggtgccccagtgtgcgtaaccttcttccgtcctcggacggtagtgattggttaagatttggtgtaaggttcatgtgccaacgccctgtgcgggatgaaacctctactgccctaggaatgccaggcaggtaccccaccctcgggtgggatctgagcctgggctaattgtctacgggtagtttcatttccaattctttcatgtcggagtc

SEQ ID NO: 1312 - DNA, 677 bp, Aichi virus
  strain D/VI2169/2004 polyprotein gene, complete cds.1
gttactccattcagcttcttcggaacctgttcggaggaattaaacgggcacccatacacccccacccccttttctgcaacttaagtatgtgtgctcgtaatcttgactcccacggaatggatcgatccgctggagaacaaactgctagatccacatcctcccttcccctgggaggaccccggtcctcccacatcctccccccagcctgacgtatcacaggctgtgtgaagtccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccaccttcgggtgggatctgagcctgggctaattgtctacgggtagtttcatttccaattcttttatgtcggagtc

SEQ ID NO: 1313 - DNA, 677 bp, Aichi virus
  strain D/VI2244/2004 polyprotein gene, complete cds.1
gttactccattcagcttcttcggaacctgttcggaggaattaaacgggcacccatacacccccacccccttttctgcaacttaagtatgtgtgctcgtaatcttgactcccacggaacggatcgatccgctggagaacaaactgctagatccacatcctcccttcccctgggaggaccccggtcctcccacatcctccccccagcctgacgtaacacaggctgtgtgaagtccccgcgaaagctgctcacgtggcaattgtgggtccccccttcaccaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccaccttcgggtgggatctgagcctgggctaattgtctacgggtagtttcatttccaattcttttatgtcggagtc

SEQ ID NO: 1314 - DNA, 677 bp, Aichi virus
  strain D/VI2359/2004 polyprotein gene, complete cds.1
gttactccattcagcttcttcggaacctgttcggaggaattaaacgggcacccatacacccccacccccttttctgcaacttaagtatgtgtgctcgtaatcttgactcccacggaatggatcgatccgctggagaacaaactgctagatccacatcctcccttcccctgggaggaccccggtcctcccacatcctccccccagcctgacgtatcacaggctgtgtgaagtccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccaccttcgggtgggatctgagcctgggctaattgtctacgggtagttccatttccaattcttttatgtcggagtc

SEQ ID NO: 1315 - DNA, 677 bp, Aichi virus
  strain D/VI2287/2004 polyprotein gene, complete cds.1
gttactccattcagcttcttcggaacctgttcggaggaattaaacgggcacccatacacccccacccccttttctgcaacttaagtatgtgtgctcgtaatcttgactcccacggaatggatcgatccgctggagaacaaactgctagatccacatcctcccttcccctgggaggaccccggtcctcccacatcctccccccagcctgacgtatcacaggctgtatgaagtccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccaccttcgggtgggatctgagcctgggctaattgtctatgggtagtttcatttccaattcttttatgtcggagtc

SEQ ID NO: 1316 - DNA, 664 bp, Aichi virus
  strain D/VI2321/2004 polyprotein gene, complete cds.1
gcttcttcggaacctgttcggaggaattaaacgggcacccatacacccccacccccttttctgcaacttaagtatgtgtgctcgtaatcttgactcccacggaatggatcgatccgctggagaacaaactgctagatccacatcctcccttcccctgggaggaccccggtcctcccacatcctccccccagcctgacgtatcacaggctgtgtgaagtccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccaccttcgggtgggatctgagcctgggctaattgtctacgggtagtttcatttccaattcttttatgtcggagtc

SEQ ID NO: 1317 - DNA, 629 bp, Aichivirus A
  strain FSS693 polyprotein gene, complete cds.1
cacccatacacccccacccccttttctgtaactcaagtatgtgtgctcgtaatcttgactcccacggaatggatcgatccgctggagaacaaactgctagatccacatcctccctccccttgggaggacctcggtcctcccacatcctccctccagcctgacgtatcacaggctgtgtgaagcccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccaccttcgggtgggatctgagcctgggctaattgtctacgggtagtttcatttccaattcttttatgctggagtc

SEQ ID NO: 1318 - DNA, 487 bp, Aichi virus 1
  isolate ETH/2016/P9 polyprotein gene, partial cds.1
catcctccccccagcctgacgtaccacaggctgtgtgaagcccccgcgaaagctgctcacgtggcaattgtgggtccccccttcattaagacaccaggtctttcctccttaaggctagtcccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtcttcggacggtagtgactggttaagatttggcgtaaggttcatgtgccaacgccctgtgcgggatgaaacctctactaccctaggaatgccaggcaggtaccccaccctcgggtgggatctgagcctgggctaattgtctacgggtagtttcatttccaattcttctatgtcggagtc

SEQ ID NO: 1319 - DNA, 438 bp, Aichi virus 1
  isolate C1_Kwanak_06 polyprotein gene, partial cds.1
aagctgctcacgtggcaattgtgggtccccccttcatcaagacaccaggtctttcctccttaaggctagccccggcgtgtgaattcacgttgggcaactagtggtgtcactgtgcgctcccaatctcggccgcggagtgctgtcccccaagccaaacccctggcccttcactatgtgcctggcaagcatatctgagaaggtgttccgctgtggctgccagcctggtaacaggtgccccagtgtacgtaaccttcttccgtctccggacggtagtgattggttaagatttggtgtaaggttcatgtgccaacgccctgtgcgggatgaaacctctactgccctgggaatgccaggcaggtaccccacctccgggtgggatctgagcctgggctaattgtctacgggtagtttcatttccaatccttttatgtcggagtc

SEQ ID NO: 1320 - DNA, 724 bp, Aichivirus A
  strain rat08/rAiA/HUN, complete genome.1
tgtcggccccctcaccctcttttccggtggtctggacccggaccaccgttactccattcagcttcttcggaacctgttcggaggaattaaacgggcacccactttcctgtcctctccccttttctgtaactccaagtgtgtgctcgtaatcttgactcccgcggattgaccgctccgctggtgaacaaactgctaggtcatctcctccccacccttgggcgtccttccgggcgtccacaccctccccccagcctgacgtgtcacaggctgtacaaagaccccgcgaaagctgctaacgtggcaattgtgggtcccccctttgtaaaggaaccgagtctttctcccttaaggctagacccctgtgtgaattcacaggtggcaactagtggttccactgcatgctcccgacctcggccgcggagtgctgttccccaagtcgtaacactgaccttcacttatgtgcctggcaagcatatctgagaagatgttccgctgtggctgccaaacctggtaacaggtgccccagtgtgcgtagtcttcttccgtcttcggacggtaggtgttaggtaaagatgcggcgtaaggttcaagtgccaacgccctggaagggatgacccttctactgccctaggaatgccgcgcaggtaccccaggttcgcctgggatctgagcgcgggctaattgtctacgggtagtttcatttccctcttcttccactggcatc

SEQ ID NO: 1321 - DNA, 438 bp, Aichi virus 1
  isolate Inlet_2011MAR_Aichi_A leader protein gene,1
aagctgctcacgtggcaattgtgggtccccccttcatcaagacaccaggtctttcctccttaaggctagccccgacgtgtgaactcacgttgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtcttcggacggtagtgattggttaagatttggtgtaaggttcatgtgccaacgccctgtgcgggatgaaacctctactgccctaggaatgccaggcaggtaccccaccttcgggtgggatctgagcctgggctaattgtctacgggtagtttcatttccaattcttttatgtcggagtc

SEQ ID NO: 1322 - DNA, 438 bp, Aichi virus 1
  isolate C3_Seongbuk_09 polyprotein gene, partial cds.1
aagctgctcacgtggcaattgtgggtccccccttcatcaagacaccaggtctttcctccttaaggctagccccggcgtgtgaactcacgttgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtcttcggacggtagtgattggttaagatttggtgtaaggttcatgtgccaacgccctgtgcgggatgaaacctctactgccctaggaatgccaggcaggtaccccaccttcgggtgggatctgagcctgggctaattgtctacgggtagtttcatttccaattctttcatgtcggagtc

SEQ ID NO: 1323 - DNA, 438 bp, Aichi virus 1
  isolate Inlet_2011JAN_Aichi_B leader protein gene,1
aagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgcggctgccaccctggtaacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccacccccgggtgggatctgagcctgggctaattgtctacgggtagtttcatttccaattcttttatgtcggagtc

SEQ ID NO: 1324 - DNA, 438 bp, Aichi virus 1
  isolate C4_Yongdeongpo_07 polyprotein gene, partial1
aagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccggtgtgcgtaaccttcttccgtctccggacggtagtgattggttaagatttggtgtaaggttcatgtgccaacgccctgtgcgggatgaaacctctactgccctaggaatgccaggcaggtaccccacccccgggtgggatctgagcctgggctaattgtctacgggtagtttcatttccaattcttttatgtcggagtc

SEQ ID NO: 1325 - DNA, 438 bp, Aichi virus 1
  isolate Inlet_2011JAN_Aichi_A leader protein gene,1
aagctgctcacgtggcaattgtgggtccccccttcatcaagacaccaggtctttcctccttaaggctagccccggcgcgtgaactcacgttgggcaactagtggtgtcactgtgcgctcccaacctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtcttcggacggtagtgattggttaagatttggtgtaaggttcatgtgccaacgccctgtgcgggatgaaacctctactgccctaggaatgccaggcaggtaccccaccctcgggtgggatctgagcctgggctaattgtctacgggtagtttcatttccaattcttttatgtcggagtc

SEQ ID NO: 1326 - DNA, 438 bp, Aichi virus 1
  isolate C2_Kangdong_01 polyprotein gene, partial cds.1
aagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtctccggacggtagtgattggttaagatttggcgtaaggttcatgtgccaacgccctgtgcgggatgaaacctctactgccctaggaatgccaggcaggtaccccaccctcgggtgggatctgagcctgggctaattgtctacgggtagtttcatttccaattcttttatgtcggagtc

SEQ ID NO: 1327 - DNA, 438 bp, Aichi virus 1
  isolate C2_Eunpyeong_01 polyprotein gene, partial1
aagctgctcacgtggcaattgtgggtccccccttcatcaagacaccaggtctttcctccttaaggctagccccggcgtgtgaactcacgttgggcaactagtggtgtcactgtgcgctcccaatctcggccgcagagtgctgttccccaagccaaacccctggcccttcactatgtgcctggcaagcatatctgagaaggtgttccgctgtggctgccagcctggtaacaggtgccccagtgtgcgtaaccttcttccgtcttcggacggtagtgattggttaagatttggtgtaaggttcgtgtgccaacgccctgtgcgggatgaaacctctactgccctaggaatgccaggcaggtaccccaccttcgggtgggatctgagcctgggctaattgtctacgggtagtttcatttccaattctttcatgtcggagtc

SEQ ID NO: 1328 - DNA, 438 bp, Aichi virus 1
  isolate C6_Mapo_22 polyprotein gene, partial cds.1
aagctgctcacgtggcaattgtgggtccccccttcatcaagacaccaggtctttcctccttaaggctagccccggcgtgtgaactcgcgttgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtcttcggacggtagtgattggttaagatttggtgtaaggttcgtgtgccaacgccctgtgcgggatgaaacctctactgccctaggaatgccaggcaggtaccccaccttcgggtgggatctgagcctgggctaattgtctacgggtagtttcatttccaattccttcatgtcggagtc

SEQ ID NO: 1329 - DNA, 438 bp, Aichi virus 1
  isolate C4_Yongdeongpo_16 polyprotein gene, partial1
aagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccggtgtgcgtaaccttcttccgtctccggacggtagtgattggttaagatttggtgtaaggttcatgtgccaacgccctgtgcgggatgaaacctctactgccctaggaatgccaggcaggtaccccaccctcgggtgggatctgagcctgggctaattgtctacgggtagtttcatttccaattctttcatgtcggagtc

SEQ ID NO: 1330 - DNA, 725 bp, Aichivirus A
  strain Wencheng-Rt386-2 polyprotein gene, complete1
cctcggccccctcaccctcttttccggtggtctggacccggaccaccgttactccattcagcttcttcggaacctgttcggaggaattaaacgggcacccactttcctgtcctctccccctttctgcaactcaagtgtgtgctcgtaatcctgactcccacgggttgaccgccccgttggtgaacaaacagctaggtcattccctccctacccctgggcgccatttcagtggcgttcatatcctccccccagcctgacgtgtcacaggctgtgcaaagtccccgcgaaagctgctcacgtggcaattgtgggtcccccctttgtgaaggaaccgagtctttctcccttaaggctagacccctgtgtgaactcacaggtggcaactagtggttccactgcatgctcccgacctcggccgcggagtgctgttccccaagtcgtgacactgacctccacttatgtgcctggcaagcatatctgagaagatgttccgctgtggctgccaaacctggtaacaggtgccccagtgcgtgtagtcttcttccgtctccggacggtaagtgtgtggtaaagatgcggcgtaaggttcaagtgccaacgccctggaagggatgacccttctactgccctaggaatgccgcgcaggtaccccaggttcgcctgggatctgagcgcgggctaattgtctacgggtagtttcatttccctctcttttcactggcatc

SEQ ID NO: 1331 - DNA, 438 bp, Aichi virus 1
  isolate C5_Mapo_01 polyprotein gene, partial cds.1
aagctgctcacgtggcaattgtgggtccccccttcatcaagacaccaggtctttcctccttaaggctagccccggcgtgtgaactcacgttgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgcccccgtgtgcgtaaccttcctccgtcttcggtcggtagtgattggttaagatttggtgtaaggttcgtgtgccaacgccctgtgcgggatgaaacctctactgccctaggaatgccaggcaggtaccccaccttcgggtgggatctgagcctgggctaattgtctacgggtagtttcatttccaattccttcatgtcggagtc

SEQ ID NO: 1332 - DNA, 395 bp, Kobuvirus sp.; identical to SEQ ID NO: 431
  strain 16806x8 polyprotein gene, partial cds.1

SEQ ID NO: 1333 - DNA, 733 bp, Marmot kobuvirus
  strain HT9, complete genome.1
cttcggccctcacaccctcttttccgatggtctggtcccggaccaccgtcactccattcagcttcttcggaacctgttcggaggaattaaacgggcaccccacttcccccccccaccctcgcaacttcaagtgtgtgtgcccataaccttgacccctgccggtatgccgcccggttcagtggacaaactgctaggcaaattcccccctccccctgtggctggtccttcaaccagccactctcttccccccagccggacgtgctacaggctgtgcaaagcccccgcgaaagctgctcacgtggcaattgtgggtcccccctttgtcaaggcttcgagtctttctcccttaaggctagtcccgtactgtgaaatcagtgtgggcaactagtgaagccactgcacgctcccgaccacggacgcggagtgctgtcccccaagtcatgacactaacaccaagctgtgctgcctggcaagcatagcctgggaaggtgttccgctgtggctgccaaacctggtaacaggtgccccagtgtgtgtaaccttcctccagtcttcggactggcagctttgtgtgaagacgtgacgtaaggttcaagtgccaactccctggaagggatgacccctctactgccctaggaatgctacgcaggtacccctggttcgccagggatctgagcgtaggctaattgtctacgggtagtttcatttcccacctttttatttctttagcatc

SEQ ID NO: 1334 - DNA, 729 bp, Feline kobuvirus
  isolate FKV/18CC0718, complete genome.1
cctcggccccctcaccctcttttccggtggtctggtcccggaccaccgttactccattcagcttcttcggaacctgttcggaggaattaaacgggcacccactcatccctacctccccctgtaacttgaagtgtgtgctcgtgaccttgactcctgcgggcttcaccgacccgtccagtgaacaaactgctaggtgatttcttcccctcccctgacctggatgttccacatccaggtcttcctcccccagcccgacatgtcatgggctgtttggaatccccgcgaaagctgctaacgtggcaattgtgggtcccccttccaacaagacaccgagtctttctcccttaaggctagccccgtgtggtgaattccaccgggcaactagtgatgtcaatgcatgcctccgacctcggccgcggagtgctgccccccaagttgcgaaactgaccaaggattgtgctgcctggcaagcatagtctgaggagatgttccgctgtggctgccaaacctggtaacaggtgccccagtgcgcgtagtctccttccggttcgtccggctgtcctttggtaaagacacaatgtaaggggcgtgtgccaacgccctggaaagagtgaacttctactgccctaggaatgccacgcaggtacccctggtctcctaccagggatctgagcgtgggctaattgtctaacgggtagtttcatttctctcctcccttttgttgacacc

SEQ ID NO: 1335 - DNA, 729 bp, Feline kobuvirus
  isolate FKV/18CC0503, complete genome.1
cctcggccccctcaccctcttttccggtggtctggtcccggaccaccgttactccattcagcttcttcggaacctgttcggaggaattaaacgggcacccactcacccccatctccccctgtaacttgaagtgtgtgctcgtgaccttgactcctgcgggcttcaccgacccgtccagtgaacaaactgctaggtgatttcttcccctcccctagcctggatgttccacatccaggtcttcttcccccagcccgacatgtcatgggctgtttggaatccccgcgaaagctgctaacgtggcaattgtgggtcccccttccaacaagacaccgagtctttctcccttaaggctagccccgtgtggtgaattccaccgggcaactagtggtgtcaatgcatgcctccgacctcggccgcggagtgctgccccccaagttgcgaaactgaccaaggattgtgctgcctggcaagcatagtctgaggagatgttccgctgtggttgccaaacctggtaacaggtgccccagtgcgcgtagtctccttccggttcgtccggctgtcctttggtaaagacacaatgtaaggggcgtgtgccaacgccctggaaagagtgaacttctactgccctaggaatgccacgcaggtacccctggtttcttaccagggatctgagcgtgggctaattgtctaacgggtagtttcatttccctcccttcttttgttgacatc

SEQ ID NO: 1336 - DNA, 717 bp, Feline kobuvirus
  isolate 12D240, complete genome.1
tcaccctcttttccggtggtccggtcccagaccaccgttactccactcagcttcttcggaacctgtctggaggaattaaacgggcacccactcatccccaccccccttgtaacttaaagtgtgtgctcgtgaccttgactcctgcgggcttcaccgacccgttcagtgaacagactgctaggtgatttcttccccttccctggcctggatggcccacatccaggtccccttcccccagcccgacatgtcatgggctgtttggaatccccgcgaaagctgctaacgtggcaattgtgggtcccccttccaacaagacaccgagtctttctcccttaaggctagccccgtgtggtgaattccaccgggcaactagtgacgccactgcatgcctccgacctcggccgcggagtgctgccccccaagttgtgaaactggccaaggactgtgctgcctggcaagcatagtctgaggagatgttccgctgtggctgccaaacctggtaacaggtgccccagtgtgcgtagtctccttccggttcgtccggctgtcctttggtaaagacacaatgtaaggggcgtgtgccaacgccctggaaagagtgaacttctgctgccctaggaatgccacgcaggtacccctggtttcccaccagggatctgagcgtgggctaattgtctaacgggtagtttcatttccctcctctcttttgttgacatc

SEQ ID NO: 1337 - DNA, 523 bp, Rat kobuvirus
  MM33, partial genome.1
cctccccacccctgggcgccgcctaggcgacgtccacatcctccccccagcctgacgtgtcacaggctgtgcaaagaccccgcgaaagctgctcacgtggcaattgtgggtcccccctttgtgaaggaaccgagtctttctcccttaaggctagacccctgtgtgaattcacaggtggcaactagtggttccactgcatgctcccgacctcggccgcggagtgctgttccccaagtcgtaacactgacctccacttatgtgcctggcaagcatatctgagaagatgttccgctgtggctgccaaacctggtaacaggtgccccagtgtgcgtagtcttcttccgtctccggacggtaagtgtgtggtaaagatgcggcgtaaggttcaagtgccaacgccctggaagggatgacccttctactgccctaggaatgccgcgcaggtaccccaggttcgcctgggatctgagcgcgggctaattgtctacgggtagtttcatttccctctttcttcactggcatc

SEQ ID NO: 1338 - DNA, 534 bp, Rat kobuvirus
  GZ85, partial genome.1
ctaggtcattccctccccacccctgggcgccgcttcggcggtgtccacatcctccccccagcctgacgtgtcacaggctgtgcaaagaccccgcgaaagctgctcacgtggcaattgtgggtcccccctttgtgaaggaaccgagtctttctcccttaaggctagacccctgtgtgaattcacaggtggcaactagtggttccactgcatgctcccgacctcggccgcggagtgctgttccccaagtcgtaacactgacctccacttatgtgcctggcaagcatatctgaaaagatgttccgctgtggctgccaaacctggtaacaggtgccccagtgtgcgtagtcttcttccgtcttcggacggtaagtgtgtggtaaagatgcggcgtaaggttcaagtgccaacgccctggaagggatgacccttctactgccctaggaatgccgcgcaggtaccccaggttcgcctgggatctgagcgcgggctaattgtctacgggtagtttcatttccctctttcttcactggcatc

SEQ ID NO: 1339 - DNA, 306 bp, Aichi virus 1
  isolate ETH/2016/P24 polyprotein gene, partial cds.1
cggagtgctgttccccaagccaaacccctggcccttcactatgtgcctggcaagcatatctgagaaggtgttccgctgtggctgccagcctggtaacaggtgccccagtgtgcgtaaccttcttccgtcttcggacggtagtgattggttaagatttggcgtaaggttcatgtgccaacgccctgtgcgggatgaaacctctactaccctaggaatgccaggcaggtaccccaccctcgggtgggatctgagcctgggctaattgtctacgggtagtttcatttccaattcttctatgtcggagtc

SEQ ID NO: 1340 - DNA, 301 bp, Aichi virus 1
  isolate ETH/2016/P6 polyprotein gene, partial cds.1
gtgctgttccccaagccaaacccctggccctccactatgtgcctggcaagcatacctgagagggtgttccgctgtggctgccagcctggtaacaggtgccccagtgtgcgtaaccttcttccgtcttcggacggtagtgatcggttaagatttggtgtaaggttcatgtgccaacgccctgtgcgggatgaacctctactgccctaggaatgccaggcaggtaccccaccctcgggtgggatctgagcctgggctaattgtctacgggtagtttcatttccaatccttttatgtcggagtc

SEQ ID NO: 1341 - DNA, 610 bp, Mouse kobuvirus; identical to SEQ ID NO: 665
  M-5/USA/2010, complete genome.1

SEQ ID NO: 1342 - DNA, 711 bp, Canine kobuvirus
  strain CaKoV-26, complete genome.1
tcaccctcttttccggtggtccggacccagaccaccgttactccattcagcttcttcggaacctgttcggaggaattaaacgggcacccactcaccccctctccctcctcgtaactaagtgtgtgcccagtctctttactcctgctggcttcaccgaccagtagtggccaaaatgctaggtgaacctcctccctcccccactgggctcccgcccagtttcctccccccagcctgacgtgtcacaggctgtgcaaagaccccgcgaaagctgccaaaagtggcaattgtgggtcccccctttgtcaaggcgtcgagtctttctcccttaaggctagccccgtcagtgaattctgtcgggcaactagtgacgccactgcatgcctccgacctcggccgcggagtgctgccccccaagtcatgcccctgaccacaagttgtgctgtctggcaaacattgtctgtgagaatgttccgctgtggctgccaagcctggtaacaggctgccccagtgtgtgtagttctcatccggacttcggtctggcaacttgctgttaagacatggcgtaaggggcgtgtgccaacgccctggaacgagtgtccactctaataccccgaggaatgctacgcaggtacccctggcctgccagggatctgagcgtaggctaattgtctaagggtattttcatttcccactctttctttcttgttcata

SEQ ID NO: 1343 - DNA, 713 bp, Canine kobuvirus 1; identical to SEQ ID NO: 871
  isolate 12D049, complete genome.1

SEQ ID NO: 1344 - DNA, 712 bp, Canine kobuvirus; identical to SEQ ID NO: 867
  US-PC0082, complete genome.1

SEQ ID NO: 1345 - DNA, 712 bp, Canine kobuvirus 1; identical to SEQ ID NO: 866
  isolate DD2 polyprotein mRNA, complete cds.1

SEQ ID NO: 1346 - DNA, 711 bp, Canine kobuvirus
  strain S272/16, complete genome.1
tcaccctcttttccggtggtccggacccagaccaccgttactccattcagcttcttcggaacctgtttggaggaattaaacgggcacccacccaccttcacccccttttcgtaactaagtgtgtgcccaatctcatgactcctgctgacttcaccgaccagcagtgtccaaaacgctaggtgaatttccttcctccccctctgggcttctgcccagctccctccctccagcctgacgtgccacaggctgtgcaaagaccccgcgaaagctgccaaaagtggcaattgtgggtcccccctttgtaaaggcgtcgagtctttctcccttaaggctagacccgtcagtgaattctgtcgggcaactagtgacgccactgcatgcctccgacctcggccgcggagtgctgccccccaagtcgtgcccctgactacaagttgtgctgtctggcaaacattgtctgtgagaatgttccgctgtggctgccaagcctggtaacaggctgccccagtgtgcgtagttctcatccagacttcggtctggcaacttgctgttaagacacggcgtaaggggcgtgtgccaacgccctggaacgagtgtccactctaataccccgaggaatgctacgcaggtacccctggctccccagggatctgagcgtaggctaattgtctaagggtattttcatttcccactctttctttcttgttcata

SEQ ID NO: 1347 - DNA, 646 bp, Feline kobuvirus
  strain FK-13, complete genome.1
ggaattaaacgggcacccactcacccccatccccccctgtaacttaaagtgtgtgctcgtgaccttgactcctgcgggcttcaccgacccgtccagtgaacaaactgctaggtgactccttccccccccctggcctggatggcccacatccaggtcttcttcccccagcccgacatgtcatgggctgtttggaatccccgcgaaagctgctaacgtggcaattgtgggtcccccttccaacaagacaccgagtctttctcccttaaggctagccccgtgtggtgaattccaccgggcaactagtggtgtcaatgcatgcctccgacctcggccgcggagtgctgccccccaagttgcgaaactgaccaagactgtgctgcctggcaagcatagtctgaggagatgttccgctgtggttgccaaacctggtaacaggtgccccagtgtgcgtagtctccttccggttcgtccggctgtcctttggtaaagacacaatgtaaggggcgtgtgccaacgccctggaaagagtgaacttctactgccctaggaatgccacgcaggtacccctggtttcccaccagggatctgagcgtgggctaattgtctaacgggtagtttcatttccctcctctcttttgttgacatc

SEQ ID NO: 1348 - DNA, 712 bp, Canine kobuvirus 1
  isolate 75 polyprotein mRNA, complete cds.1
tcaccctcttttccggtggtccggacccagaccaccgttactccattcagcttcttcggaacctgttcggaggaattaaacgggcacccactcaccccctctccctcctcgtaactaagtgtgtgcccagtctctttactcctgctggcttcaccgaccagtagtggccaaaatgctaggtgaacctcctccctcccccactgggctcccgcccagtttcctccccccagcctgacgtgtcacaggctgtgcaaagaccccgcgaaagctgccaaaagtggcaattgtgggtcccccctttgtcaaggcgtcgagtctttctcccttaaggctagacctgtcagtgaattctgccgggcaactagtgacgccactgcatgcctccgacctcggctgcggggtgctgccccccaagttgtgcccctgagccacaagttgtgctgtctggcaaacattgtctgtgagaatgttccgctgcggctgccaagcctggtgacaggctgccccagtgtgtgtagttctcatccagacctcggtctggcaacttgctgttaagacacggcgtaaggggcgtgtgccaacgccctggaacgagtgtccattctaataccccgaggaatgctacgcaggtacccctggttcaccagggatctgagcgtaggctaattgtctaagggtattttcatttcccactctttctttcttgttcata

SEQ ID NO: 1349 - DNA, 712 bp, Canine kobuvirus 1
  isolate B103 polyprotein mRNA, complete cds.1
tcaccctcttttccggtggtccggacccagaccaccgttactccattcagcttcttcggaacctgttcggaggaattaaacgggcacccactcaccctctctccctcctcgtaactaagtgtgtgcccagtctctttactcctgctggcttcaccgaccagtagtgaccaaaatgctaggtgaacctcctcccacgccctctgggcccccgcccagtttcctccccccagcctgacgtgtcacaggctgtacaaagaccccgcgaaagctgccaaaagtggcaattgtgggtcccccctttgtcaaggcgtcgagtctttctcccttaaggctagacccgtcagtgaattctgccgggcaactagtgacgccactgcatgcctccgacctcggctgcggagtgctgccccccaagtcgtgcccctgagccacaagttgtgctgtctggcaaacattgtctgtgagaatgttccgctgcggctgccaggcctggtaacaggctgccccagtgtgtgtagttctcatccagatctcggtctggcaacttgctgttaagacacggcgtaaggggcgtgtgccaacgccctggaacgagtgtccattctaataccccgaggaatgctacgcaggtacccctggtgaaccaggggtctgagcgtaggctaattgtctaagggtattttcatttcccactctttctttcttgttcata

SEQ ID NO: 1350 - DNA, 646 bp, Feline kobuvirus
  strain FeKoV/TE/52/IT/13, complete genome.1
ggaattaaacgggcacccactcacccccatccccccctgtaacttaaagtgtgtgctcgtgaccttgactcctgcgggcttcaccgacccgtccagtgaacaaactgctaggtgatttcttcccctccctcagcctgggtgttccacatccaggtctttttcccccagcccgacatgtcatgggctgtttggaatccccgcgaaagctgctaacgtggcaattgtgggtcccccttccaacaagacaccgagtctttctcccttaaggctagccccgtgtggtgaactccaccgggcaactagtggtgtcaatgcatgcctccgacctcggccgcggagtgctgccccccaagttgtgaaactgaccaaggatgtgctgcctggcaagcatagtctgaggagatgttccgctgtggctggcaagcctggtaacaggtgccccagtgtgcgtagtctccttccggttcgtccggctgtcctttggtaaagacacaatgtaaggggcgtgtgccaacgccctggaaagagtgaacttttactgccctaggaatgccacgcaggtacccctggtttcccaccagggatctgagcgtgggctaattgtctaacgggtagtttcatttccctcctctcttttgttgacatc

SEQ ID NO: 1351 - DNA, 647 bp, Feline kobuvirus
  strain WHJ-1, complete genome.1
ggaattaaacgggcacccactcatccctacctccccctgtaacttgaagtgtgtgctcgtgaccttgactcctgcgggcttcaccgacccgtccagtgaacaaactgctaggtgatttcttccccttcccccacctggatgttctacatccaggtcttcctcccccagcccgacatgtcatgggctgtttggaacccccgcgaaagctgctaacgtggcaattgtgggtcccccttccaacaagacaccgagtctttctcccttaaggctagccccgtgtggtgaattccaccgggcaactagtggtgtcaatgcatgcctccgacctcggccgcggagtgctgccccccaagttgtgaaactgaccaaggattgtgctgcctggcaagcatagtctgaggagatgttccgctgtggctgccaaacctggtaacaggtgccccagtgcgcgtagtctccttccggttcgtccggctgtcctctggtaaagacacaatgtaaggggtgtgtgccaacgccctggaaagagtgaacttctactgccctaggaatgccacgcaggtacccctggtcccccaccagggatctgagcgtgggctaattgtctaacgggtagtttcatttctctcctctcctttgttgacatc

SEQ ID NO: 1352 - DNA, 579 bp, Murine kobuvirus 1
  isolate MKV1/NYC/2014/M014/0146, partial genome.1
gccaggtcgcatcgcctggttggtgaccaaactgctagatgctcctccctttccctcggggttggcgcaccgccatccctgcatcctccccccagcctgacatgctacaggctgtgcaagaaccccgcgaaagctgccaccgtggcaattgtgggtccccctcttgtcaaggcacagagtctttctcccttaaggctagacccctctgtgaattcagaggcggcaactagttgtgccactacatgcctcagacctcggtcgcggagtgctgttccccaaaccctgacactgccgcgtgagtatgctgcttggcaagcattgcctggatggtcgttccgctggggctgccaggtctggtaacagaccgctccagtgtgcgtagaccatctccagcttcggctggtgctcacaaggtaagactcggtgtaaggttcatgtgccaacaccctggaatgagtgaaaactctactgccctaggaatgctacgcaggtacccctgctcccttgggagccagggatctgagcgtaggctaattgtctgtcgggtagtttcatttcccacctcctagactgttcacc

SEQ ID NO: 1353 - DNA, 601 bp, Canine kobuvirus
  CH-1, complete genome.1
tttaagtgttgtgcccaatctcttgactcctgctggaaccaccgaccagtagtgtccaaaatgctaggtggaaaatcctcccttcccctctgggctccatgcccagcatcctccccccagcctgacgtgtcacaggctgtgcaaagaccccgcgaaagctgccaaaagtggcaattgtgggtcccccctttgtcaaggcgtcgagtctttctcccttaaggctagccccgtcagtgaattctgacgggcaactagtgacgccactgcatgcctccgacctcggccgcggagtgctgccccccaagtcatgcccctgaccacaagttgtgctgtctggcaaacactgtctgtgagaatgttccgctgtggctgccaagcctggtaacaggctgccccagtgtgcgtagttctcatccagacctcggtctggcaacttgctgttaagacatggcgtaaggggcgtgtgccaacgccctggaacgagtgtccactctaataccccgaggaatgctacgcaggtacccctggttcgccagggatctgagcgtaggctaattgtctaagggtattttcatttcccactctctctttcttgttcata

SEQ ID NO: 1354 - DNA, 601 bp, Canine kobuvirus
  isolate SMCD-59, complete genome.1
tttaagtgttgtgcccaatctcttgactcctgctggaaccaccgaccagtagtgtccaaaatgccaggtggaaaatcctcccttcccctctgggcttcatgcccggcatcctccccccagcctgacgtgccacaggctgtgcaaagaccccgcgaaagctgccaaaagtggcaattgtgggtcccccctttgtcaaggcgtcgagtctttctcccttaaggctagtcctgtcagtgaactctgtcgggcaactagtgacgccactgcatgcctccgacctcggccgcggagtgctgccccccaagtcatgcccctgaccacaagttgtgctgtctggcaaacattgtctgtgagaatgttccgctgtggctgccaagcctggtaacaggctgccccagtgtgcgtaattctcatccagacttcggtctggcaacttgctgttaagacatggcgtaaggggcgtgtgccaacgccctggaacgagtgtccactctaataccccgaggaatgctacgcaggtacccctggctcgccagggatctgagcgtaggctaattgtctaagggtattttcatttcccaccctcttcttcttgttcata

SEQ ID NO: 1355 - DNA, 493 bp, Canine kobuvirus
  isolate CaKoV_CE9_AUS_2012 polyprotein gene,1
tcctccccccagcctgacgtgtcacaggctgtgcaaagaccccgcgaaagctgccaaaagtggcaattgtgggtcccccctttgtcaaggcgtcgagtctttctcccttaaggctagccccgacagtgaattctgtcgggcaactagtgacgccactgcatgcctccgacctcggccgcggagtgctgccccccaagtcgtgcccctgactacaagttgtgctgtctggcaaacattgtctgtgagaatgttccgctgtggctgccaagcctggtaacaggctgccccagtgtgcgtagttctcatccagacttcggtctggcaacttgctgttaagacgcggcgtaaggggcgtgtgccaacgccctggaacgagtgtccactctaataccccgaggaatgctacgcaggtacccctggctcgccagggatctgagcgtaggctaattgtctaagggtattttcatttcccactctttctctctcgttcata

SEQ ID NO: 1356 - DNA, 612 bp, Canine kobuvirus; identical to SEQ ID NO: 680
  strain UK003, complete genome.1

SEQ ID NO: 1357 - DNA, 766 bp, Kobuvirus SZAL6-KoV/2011/HUN; identical to SEQ ID NO: 1227
  complete genome.1

SEQ ID NO: 1358 - DNA, 561 bp, Kobuvirus dog/AN211D/USA/2009
  polyprotein gene, complete cds.1
ccgaccagtagtgtccgaaatgctagagtggacttcctcccttcccctctgggtatcttgcccagtttcctccccccaacctgacgtgccacaggctgtgaaaacaccccgcgaaagctgccaaaagtgggaattgtgggtccccccctttgccaaggagtcgagtctttctcccttaaggctagccccatcagtgaattctgttgggcaactagtgacgccactgcatgcctccgacctcggccgcggagtgctgccccccaagtcgtgcccctgaccacaagttgtgctgtctggcaaacattgtctgtgagaatgttccgctgtggctgccaagcctggtaacaggctgccccagtgtgcgtagttctcatccagacttcggtctggcaacttgctgttaagacacggcgtaaggggcgtgtgccaacgccctggaacgagtgtccactctaataccccgaggaatgctacgtaggtacccctggttcgccagggatctgagcgtaggctaattgtctaagggtattttcatttcccactctctctttcttgttcata

SEQ ID NO: 1359 - DNA, 699 bp, Salivirus A
  strain GUT/2009/A-1746, complete genome.1
tatggcaggcgggcttgtggacggtttcggcccacccacagcaagaatgccatcatctgtcctcacccccaattttccctttcttcccctgcaatcatcacgcttactcgcatgtgcattgagtggtgcatgtgttgaacaaacagctacactcacatgggggcgggttttcccgccctacggcctctcgcgaggcccacccttcccctccccttataactacagtgctttggcaggtaagcatcctgatcccccgcggaagctgctcacgtggcaactgtggggacccagacaggttatcaaaggcacccggtctttccgccttcaggagcatccccactagtgaattctagtggggctctgcttggtgccaacctcccccaaatgcgcgctgcgggagtgctcttccccaacccatcctagtatcctctcatgtgtgtgcttggtcagcatatctgagacgacgttccgctgtcccagaccagtccagtaatggacgggccagtgtgcgtagtcgtcttccggcttgtccggcgcatgtttggtgaaccggtggggtaaggttggtgtgcccaacgcccgtactttggtgacacctcaagaccacccaggaatgccagggaggtaccccgcctcacggcgggatctgaccctgggctaattgtctacggtggttcttcttgcttccacttctttctt

SEQ ID NO: 1360 - DNA, 709 bp, Salivirus NG-J1
  complete genome.1
tatggcaggcgggcttgtggacggcttcggcccacccacagcaagaatgccatcatctgtcctcacccccaattttcccttttcttcccctgcaaccattacgcttactcgcatgtgcattgagtggtgcatgtgttgaacaaacagctacactcacatgggggcgggttttcccgccctacggcctctcgcgaggcccaccccttccctccccttataactacagtgctttggtaggtaagcatcctgatcccccgcggaagctgctcacgtggcaactgtggggacccagacaggttatcaaaggcacccggtctttccgccttcaggagtatccctactagtgaattctagcggggctctgcttggtgccaacctcccccaaatgcgcgctgcgggagtgctcttccccaactcaccctagtatcctctcatgtgtgtgcttggtcagcatatctgagacgatgttccgctgtcccagaccagtccagtaatggacgggccagtgcgtgtagtcgtcttccggcttgtccggggcatgtttggtgaaccggtggggtaaggttggtgtgcccaacgcccgtactttggtgacacctcaagaccacccaggaatgccagggaggtaccccacctcacggtgggatctgaccctgggctaattgtctacggtggttcttcttgcttccacttctttcttctgttcacg

SEQ ID NO: 1361 - DNA, 720 bp, Salivirus A
  strain YZ03, complete genome.1
cccctttcgaccgacctatggcaggcgggcttgtggacggcttcggcccacccacagcaagaatgccatcatctgtcctcacccccatcttcccctttcttccctgcaaccgtcacgcttactcgcatgtgcattgagtggtgcacgtgtcgaacaaacagctacactcacatggggcgggttttcccgccttgcggcctctcgcgaggcccacccctccctctcctcccataactacagtgctttggtaggtaagcatcctgatcccccgcggaagctgctcacgtggcaactgtggggacccagacaggttatcaaaggcacccggtctttccgccttcaggagtatccctgctagtgaattctagtagggctctgcttggtgccaacctcccccaaatgcgcgctgcaggagtgctcttccccaactcaccctagtatcctctcatgtgtgtgcttggtcagcatatctgagacgatgttccgctgtcccagaccagtccagtaatggacgggccagtgtgcgtagtcgtcttccggcttgcccggcgcatgtttggtgaaccggtggggtaaggttggtgtgcccaacgcccgtactttggtgatacctcaagaccacccaggaatgccagggaggtaccccgcttcacagcgggatctgaccctgggctaattgtctacggtggttcttcttgcttccacttctttctactgttt

SEQ ID NO: 1362 - DNA, 724 bp, Salivirus A
  strain YZ02, complete genome.1
cttccccctttcgaccgccctatggcaggcgggcttgtggacggcttcggcccacccacagcaagaatgccatcatctgtcctcacccccatcttcccctttcttccctgcaaccgtcacgcttactcgcatgtgcattgagtggtgcacgtgtcgaacaaacagctacactcacatggggcgggttttcccgccttgcggcctctcgcgaggcccacccctcccccccctcccataactacagtgctttggtaggtaagcatcctgatcccccgcggaagctgctcacgtggcaactgtggggacccagacaggttatcaaaggcacccggtctttccgccttcaggagtatccctgctagtgaattctagtagggctctgcttggtgccaacctcccccaaatgcgcgctgcaggagtgctcttccccaactcaccctagtatcctctcatgtgtgtgcttggtcagcatatctgagacgatgttccgctgtcccagaccagtccagtaatggacgggccagtgtgcgtagtcgtcttccggcttgcccggcgcatgtttggtgaaccggtggggtaaggttggtgtgcccaacgcccgtactttggtgatacctcaagaccacccaggaatgccagggaggtaccccgcttcacagcgggatctgaccctgggctaattgtctacggtggttcttcttgcttccacttctttctactgttt

SEQ ID NO: 1363 - DNA, 731 bp, Salivirus A; identical to SEQ ID NO: 931
  strain YZ01, complete genome.1

SEQ ID NO: 1364 - DNA, 650 bp, Salivirus A
  SZ1 polyprotein gene, partial cds.1
tctgtcctcaccccatcttcccttctttcctgcaccgttacgcttactcgcatgtgcattgagtggtgcacgtgcttgaacaaacagctacactcacatgggggcgggttttcccgccctgcggcctctcgcgaggcccacccctccccttcctcccataactacagtgctttggtaggtaagcatcctgatcccccgcggaagctgctcacgtggcaactgtggggacccagacaggttatcaaaggcacccggtctttccgccttcaggagtatccctgctagtgaattctagtagggctctgcttggtgccaacctcccccaaatgcgcgctgcgggagtgctcttccccaactcaccctagtatcctctcatgtgtgtgcttggtcagcatatctgagacgatgttccgctgtcccagaccagtccagtaatggacgggccagtgtgcgtagtcgtcttccggcttgtccggcgcatgtttggtgaaccggtggggtaaggttggtgtgcccaacgcccgtactttggtgatacctcaagaccacccaggaatgccagggaggtaccccgcttcacagcgggatctgaccctgggctaattgtctacggtggttcttcttgcttccacttctttctactgttcatg

SEQ ID NO: 1365 - DNA, 708 bp, Salivirus A
  isolate BN-2, complete genome.1
tatggcaggcgggcttgtggacggcttcggcccacccacagcaagaatgccatcatctgtcctcacccccatgtttcccctttctttccctgcaaccgttacgcttactcgcaggtgcatttgagtggtgcacgtgttgaataaacagctacactcacatgggggcgggttttcccgccctgcggcctctcgcgaggcccacccctccccttcctcccataactacagtgctttggtaggtaagcatcctgatcccccgcggaagctgctcacgtggcaactgtggggacccagacaggttatcaaaggcacccggtctttccgccttcaggagtatccctgctagtgaattctagtagggctctgcttggtgccaacctcccccaaatgcgcgctgcgggagtgctcttccccaactcaccctagtatcctctcatgtgtgtgcttggtcagcatatctgagacgatgttccgctgtcccagaccagtccagtaatggacgggccagtgtgcgtagtcgtcttccggcttttccggcgcatgtttggtgaaccggtggggtaaggttggtgtgcccaacgcccgtactttggtgatacctcaagaccacccaggaatgccagggaggtaccccgcttcacagcgggatctgaccctgggctaattgtctacggtggttcttcttgcttccacttctttctactgttc

SEQ ID NO: 1366 - DNA, 484 bp, Salivirus sp.
  isolate ETH_P14_2016 polyprotein gene, complete cds.1
gtgctttggcaggtaagcatcctgatcccccgcggaagctgctcacgtggcaactgtggggacccagacaggttatcaaaggcacccggtctttccgccttcaggagtaccctcactagtgaattctagtggggctctgcttggtgccaacctcccccaaatgcgcgctgcgggagtgctcttccccaacccatcctagtaccctctcatgtgtgtgcttggtcagcacatctgagacgacgttccgctgtcccagaccagtccagtaatggacgggccagtgtgcgtagtcgtcttccggcttgtccggcgcatgtttggtgaaccggtggggtaaggttggtgtgcccaatgcccgtactttggtgatacctcaagaccacccaggaatgccagggaggtaccccgcctctcggcgggatctgaccctgggctaattgtctacggtggttcttcttgcttccactcttttcttctgttcacg

SEQ ID NO: 1367 - DNA, 718 bp, Salivirus A
  isolate 02394-01, complete genome.1
tttcgaccgccttatggcaggcgggcttgtggacggcttcggcccacccacagcaagaatgccatcatctgtcctcacccccatttctcccctccttcccctgcaaccattacgcttactcgcatgtgcattgagtggtgcacgtgttgaacaaacagctacactcacgtgggggcgggttttcccgcccttcggcctctcgcgaggcccacccttccccttcctcccataactacagtgctttggtaggtaagcatcctgatcccccgcggaagctgctcgcgtggcaactgtggggacccagacaggttatcaaaggcacccggtctttccgcctccaggagtatccctgctagtgaattctagtggggctctgcttggtgccaacctcccccaaatgcgcgctgcgggagtgctcttccccaactcaccctagtatcctctcatgtgtgtgcttggtcagcatatctgagacgatgttccgctgtcccagaccagtccagcaatggacgggccagtgtgcgtagtcgtcttccggcttgtccggcgcatgtttggtgaaccggtggggtaaggttggtgtgcccaacgcccgtactttggtgacaactcaagaccacccaggaatgccagggaggtaccccgcctcacggcgggatctgaccctgggctaattgtctacggtggttcttcttgcttccatttctttcttctgttc

SEQ ID NO: 1368 - DNA, 624 bp, Salivirus CH
  complete genome.1
ttctcctgcaaccattacgcttaatcgcatgtgcattgagtggtgcatgtgttgaacaaacagctacaatcacatgggggcgggttttcccgccccacggcttctcgcgaggcccatccctcccttttctcccataactacagtgctttggtaggtaagcatcccgatctcccgcggaagctgctcacgtggcaactgtggggacccagacaggttatcaaaggcacccggtctttccgccttcaggagtatccctgctagcgaattctagtagggctctgcttggtgccaacctctcccaaatgcgcgctgcgggagtgctcttccccaaatcaccccagtatcctctcatgtgtgtgcctggtcagcatatctgagacgatgttccgctgtcccagaccagtccagtaatggacgggccagtgtgcgtagtcgtcctccggcttgtccggcgcatgtttggtgaaccggtggggtaaggttggtgtgcccaacgcccgtaatcaggggatacctcaaggcacccaggaatgccagggaggtatcccgcctcacagcgggatctgaccctggggtaaatgtctgcggggggtcctcttggcccaattctcagtaattttcagg

SEQ ID NO: 1369 - DNA, 624 bp, Salivirus A; identical to SEQ ID NO: 736
  strain SH1 polyprotein gene, complete cds.1

SEQ ID NO: 1370 - DNA, 730 bp, Salivirus FHB
  complete genome.1
acatggggggtctgcggacggcttcggcccacccgcgacaagaatgccgtcatctgtcctcattacccgtattccttcccttcccccgcaaccaccacgcttactcgcgcacgtgttgagtggcacgtgcgttgtccaaacagctacacccacacccttcggggcgggtttgtcccgccctcgggttcctcgcggaacccccccctccctctctctctttctatccgccctcacttcccataactacagtgctttggtaggtgagcaccctgaccccccgcggaagctgctaacgtggcaactgtggggatccaggcaggttatcaaaggcacccggtctttccgccttcaggagtatctctgccggtgaattccggtagggctctgcttggtgccaacctcccccaaatgcgcgctgcgggagtgctcttccccaactcatcttagtaacctctcatgtgtgtgcttggtcagcatatctgaggcgacgttccgctgtcccagaccagtccagcaatggacgggccagtgtgcgtagtcgctttccggttttccggcgcatgtttggcgaaacgctgaggtaaggttggtgtgcccaacgcccgtaatttggtgatacctcaagaccacccaggaatgccagggaggtaccccacttcggtgggatctgaccctgggctaattgtctacggtggttcttcttgcttccacttctcttttttctggcatg

SEQ ID NO: 1371 - DNA, 752 bp, Salivirus A; identical to SEQ ID NO: 128
  isolate BN-5, complete genome.1

SEQ ID NO: 1372 - DNA, 471 bp, Kobuvirus cattle/Kagoshima-1-22-KoV/2014/JPN; identical to SEQ ID NO: 12
  genomic RNA, nearly1

SEQ ID NO: 1373 - DNA, 750 bp, Rabbit picornavirus; identical to SEQ ID NO: 1201
  strain Rabbit01/2013/HUN, complete genome.1

SEQ ID NO: 1374 - DNA, 555 bp, Porcine kobuvirus
  isolate GS-2/2012/CH, complete genome.1
cctcggccccctcaccctcttttccggtggccattcgcccgggccaccgttactccactccactccttcgggactggtttggaggaacacaacagggcttcccatccctgtttaccctttattccatcatcctttccccaagtttaccctatccacaccccactgactgactcctttggattttgacctcagaatgcctatttgacctcccactcgcctctcccttttcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1375 - DNA, 555 bp, Porcine kobuvirus
  strain KobuV/Pig-wt/ESP/P2B/2017, complete1
cctcggccctctcaccctcttttccggtggccactcgcccgggccaccgttactccattccactccttcgggactggtttggaggaacataacagggcttcccatccctgtttatcctaattccacttacctttctccataattaaccctatccacaccccactgaccgatccctttggattttgacctcagaatgcctacctgacctcccacttgcctttcccttttcggattgccggtggtgcctggcggaaaaagcacaagtgtgttgatggctaccaaactcctacccgacaaaggtgcgtgtccgcgtgctgagtaatgggataggagatgccattgacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1376 - DNA, 556 bp, Porcine kobuvirus
  isolate CH/HNXX-4/2012, complete genome.1
cctcggccccctcaccctcttttccggtggccactcgcccgggccaccgttactccactccactccttcgggactggtttggaggaacataacagggcttcccatccctgtttacccttaattccatttaccttctcccccaactaaccctatccacaccccactgactgactcctttggattttgacctcagaatgcctacttgacctcccacttgcctctcccttctcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1377 - DNA, 556 bp, Porcine kobuvirus
  strain WUH1, complete genome.1
cctcggccccctcaccctcttttccggtggccactcgcccgggccaccgttactccactccactccttcgggactggtttggaggaacacaacagggcttcccatccctgttcaccctacactccacataccctttccctcaaccaaccctatccaaaccccactgaccgactcccttggattttgacctcagaatgcctacttgacctcccacttgcctctcccttctcggattgccggtggtgcctggcggaaaaagcacaagtgtgttgcaggctatcaaacttctacccgacaaaggcgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccatgcttgaccatgtactgcttgatagagtcgcggctggccgactcatgggttaaagtcagttgacaagacac

SEQ ID NO: 1378 - DNA, 555 bp, Porcine kobuvirus
  isolate K-11/2012/CH, complete genome.1
cctcggccccctcaccctcttttccggtggccacccgcccgggccaccgttactccactccactccttcgggactggtttggaggaacataacagggcttcccatccctgtttacccttattccacttaccctttcccttaaccaaccctatccacaccccactgactgattcctttggattttgacctcagaatgcctacttgacctcccacttgtctctcccttctcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1379 - DNA, 555 bp, Porcine kobuvirus
  isolate GS-1/2012/CH, complete genome.1
cctcggccccctcaccctcttttccggtggccacacgcccgggccaccgttactccactccactccttcgggactggtttggaggaacacaacagggcttcccatccctgtttaccctttattccatcatcctttccccaagtttaccctatccacaccccactgactgactcctttggattttgacctcagaatgcctatttgacctcccactcgcctctcccttttcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1380 - DNA, 555 bp, Porcine kobuvirus
  strain WB-1-HUN/2011/HUN, complete genome.1
cctcggccccctcaccctcttttccggtggccacccgcccgggccaccgttactccactccactccttcgggactggtttggaggaacataacagggcttcccatccctgtttacccttactccactcacccttctccttgaccaaccctatccacaccccactgactgactcctttggattttgacctcagaatgcctacctgacctcccacttgcctctcccatctcggactgccggtggtgcctggcggaaaaagcacaagtgtgttgatggctaccaaactcctacccgacaaaggtgcgtgtccgcgtgctgagtaatgggataggagatgccattgacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1381 - DNA, 555 bp, Porcine kobuvirus
  swine/K-30-HUN/2008/HUN, complete genome.1
cctcggccccctcaccctcttttccggtggccacccgcccgggccaccgttactccactccactccttcgggactggtttggaggaacataacagggcttcccatccctgtttacccttactccactcacccctccccttgaccaaccctatccacaccccactgactgactcctttggatcttgacctcggaatgcctacttgacctcccacttgcctctcccttttcggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1382 - DNA, 555 bp, Porcine kobuvirus
  swine/S-1-HUN/2007/Hungary, complete genome.1
cctcggccccctcaccctcttttccggtggccacccgcccgggccaccgttactccactccactccttcgggactggtttggaggaacataacagggcttcccatccctgtttacccttactccactcacccttccccttgaccaaccctatccacaccccactgactgactcctttggatcttgacctcggaatgcctacttgacctcccacttgcctctcccttttcggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1383 - DNA, 555 bp, Porcine kobuvirus
  strain KobuV/Pig-wt/ESP/VC14/2017, complete1
cctcggccctctcaccctcttttccggtggccactcgcccgggccaccgttactccactccactccttcgggactggtttggaggaacataacagggcttcccacccctgtttaccctcactccacttatccttctcctcaactaaccctatccacaccccactgattgattcctttggatttcgacctcagaatgcctacttgacctcccacttgcctctcccctctcggattgccggtggtgcctggcggaaaaagcacaagtgtgttgttggctaccaaactcctacccgacaaaggtgcgtgtccgcgtgctgagtaatgggatgggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1384 - DNA, 555 bp, Porcine kobuvirus
  strain KobuV/Pig-wt/ESP/C375/2017, complete1
cctcggccctctcaccctcttttccggtggccactcgcccgggccaccgttactccactccactccttcgggactggtttggaggaacataacagggcttcccacccctgttcacccttactccactcacccttatccttaaccaaccctatccacaccccactgactgattcctttggattttgacctcagaatgcccacctgacctcccacttgcttctcccttctcggattgccggtggtgcctggcggaaaaagcacaagtgtgttgttggctaccaaactcctacccgacaaaggtgcgtgtccgcgtgctgagtaatgggataggagatgccaatgacaggctcgcccatgagtagagcatggactgcggtgcatgtgacttcggtcaccaggggcatagcattgctcacccctgaatcaagtcatcgagacttctctgacctctgaagtgcactgtggttgcgtggctgggaatccacgcttgaccatgtactgcttgatagagtcgcggctgaccgactcatgggttaaagtcagttgacaagacac

SEQ ID NO: 1385 - DNA, 555 bp, Porcine kobuvirus
  strain KobuV/Pig-wt/ESP/P284/2017, complete1
cctcggccctctcaccctcttttccggtggccactcgcccgggccaccgttactccactccactccttcgggactggtttggaggaacataacagggcttcccatccctgtttacccttattccacttacccttctcctcaaccaaccctatccacaccccactgactgattcctttggattttgacctcagaatgcctacctgacctcccacttgcctctcccctctcggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1386 - DNA, 555 bp, Porcine kobuvirus
  strain KobuV/Pig-wt/ESP/B304/2017, complete1
cctcggccctctcaccctcttttccggtggccactcgcccgggccaccgttactccactccactccttcgggactggtttggaggaacataacagggcttcccatccctgtttaccctcattccacttacccttccccttaaccaaccctatccacaccccactgactgattcctttggattttgacctcagaatgcctacctgacctcccacttgcttctcccctctcggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgtatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1387 - DNA, 555 bp, Porcine kobuvirus
  strain KobuV/Pig-wt/ESP/C429/2017, complete1
cctcggccctctcaccctcttttccggtggccactcgcccgggccaccgttactccactccactccttcgggactggtttggaggaacataacagggcttcccacccctgttcaccctaactccacttaccctttcccttaaccaaccctatccacaccccactgattgactcccttggattttgacctcggaatgcctacttgacctcccacttgcctttcccttcccggattgccggtggtgcctggcggaaaaagcacaagtgtgttgttggctaccaaactcctacccgacaaaggtgcgtgtccgcgtgctgagtaatgggataggagatgccaatgacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1388 - DNA, 555 bp, Porcine kobuvirus
  strain KobuV/Pig-wt/ESP/VT25C/2017, complete1
cctcggccctctcaccctcttttccggtggccactcgcccgggccaccgttactccactccactccttcgggactggtttggaggaacacaacagggcttcccacccctgtttacccttactccactcacccttccccataaccaaccctatccacaccccactgactgactcctttggattttgacctcagaatgcctatttaacctcccacttgcctctcccctctcggattgccggtggtgcctggcggaaaaagcacaagtgtgttgttggctaccaaactcctacccgacaaaggtgcgtgtccgcgtgctgagtaatgggataggagatgccaatgacaggctcgcccatgagtagagcatggactgtggtgcatgtgacctcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1389 - DNA, 555 bp, Porcine kobuvirus
  strain KobuV/Pig-wt/ESP/VC20B/2017, complete1
cctcggccctctcaccctcttttccggtggccactcgcccgggccaccgttactccactccactccttcgggactggtttggaggaacataacagggcttcccatccctgtttaccctcattccacttacccttttccttaaccaaccctatccacaccccactgactgattcctttggattttgacctcagaacgcctacttgacctcccacttgcttctcccttcccggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgactccggtcaccgggggcatagcattgctcacccccgaatcaagtcatcgagatttctctgacctctgaagtgcactgtggttgtgtggctgggaatccacacttgaccatgtactgcttgatagagtcgcggctggccgactcatgggttaaagtcagttgacaagacac

SEQ ID NO: 1390 - DNA, 558 bp, Porcine kobuvirus
  isolate OH/RV11/2011, complete genome.1
cctcggccccctcaccctcttttccggtggccactcgcccgggccaccgttactccactccactccctcgggactggtttggaggaacataacagggcttcccatccctgtttttacccttatttccatctaccctttcccttaaccaaccctatccacaccccactgactgactcctttggattttgacctcagaatgcctacttgacctcccacttgcctctcccttatcggattgccggtggtgcctggtggaaaaagcacaagtgtgttgttggctaccaaactcctacccgacaaaggtgcgtgtccgcgtgctgagtaatgggataggagatgccaatgacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1391 - DNA, 555 bp, Porcine kobuvirus
  isolate JXAT2015, complete genome.1
cctcggccccctcaccctcttttccggtggccactcgcccgggccaccgttacttcactccactccttcgggactggtttggaggaacataacagggcttcccatccctgtttacccttatttccacttaactttttcccaatctactctaaccacaccccactgactgactcctttggattttgacctcagaatgcctacctggcctcccactcgcctcatccttttcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1392 - DNA, 555 bp, Porcine kobuvirus
  JS-01-CHN/2013/China, complete genome.1
cctcggccccctcaccctcttttccggtggccactcgcccgggccaccgttacttcactccactccttcgggactggtttggaggaacacaacagggcttcccaacccctgttacccttactctaattcccttttccctcaaccaaccctttccactccccactgactgactcccttggattttgacctcagaatgcctacttgacctcccacttgcctttcccttctcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1393 - DNA, 555 bp, Porcine kobuvirus
  SH-W-CHN/2010/China, complete genome.1
cctcggccccctcaccctcttttccggtggccactcgcccgggccaccgttacttcactccactccttcgggactggtttggaggaacataacagggcttcccatccctgtttaccctcattccactcaccccttccctaaaccaaccctatccacaccccactgactgactcctttggattttgacctcagaatgcctacctgacctcccacttgcctctcccttctcggattgccggtggtgcctggcggaaaaagcacaagtgtgttgcaggctaccaaactcctacccgacaaaggtgcgtgtccgcgtgctgagtaatgggataggagatgtctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1394 - DNA, 555 bp, Porcine kobuvirus
  isolate EdoMex/2018/205, complete genome.1
cttcggccctctcaccctcttttccggtggccactcgcccgggccaccgttactccactccactccttcgggactggtttggaggaacataacagggcttcccatccctgtttaccctcattccactcaccccttcccttgaccaaccccatccacaccccactgactgattcctttggattttgacctcagaatgcctacctgacctcccactcgcctctccctcttcggattgccggtggtgcctggcggaaaaagcacaagtgtgttgctggctaccaaactcctacccgacaaaggtgcgtgtccgcgtgctgagtaatgggataggagatgctaacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1395 - DNA, 555 bp, Porcine kobuvirus
  strain KobuV/Pig-wt/ESP/VC8/2017, complete1
cctcggccccctcaccctcttttccggtggccacacgcccgggccaccgttactccactccactccctcgggactggtttggaggaacacaacagggcttcccatccctgtttaccctcactccacccatccttctccttaaccaaccctatccacaccccactgactgactccattggattttgacctcagaatgcctacctgacctcccacttgcctctcccttctcggattgccggtggtgcctggcggaaaaagcacaagtgtgttgttggctaccaaactcctacccgacaaaggtgcgtgtccgcgtgctgagtaatgggataggagatgccaatgacaggctcgcccatgagtagagcatggactgcggtgcatgtgactttggtcaccaggggcatagcattgctcacccctgaatcaagtcatcgagatttctctgacctctgaagtgcgctgtggttgcgtggctgggaatccacgcttgaccatgtactgcttgatagagtcgcggctggccgactcatgggttaaagtcagttgacaagacac

SEQ ID NO: 1396 - DNA, 555 bp, Porcine kobuvirus
  strain KobuV/Pig-wt/ESP/P452/2017, complete1
cctcggccccctcaccctcttttccggtggccacacgcccgggccaccgttactccactccactccctcgggactggtttggaggaacacaacagggcttcccatccctgtttaccctcactccacttacccttctccttaaccaaccctatccacacctcactgactgattcctttggattttgacctcagaatgcctacttgacctcccacttgcctttcccttctcggattgccggtggtgcctggcggaaaaagcacaagtgtgttgttggctactaaactcctacccgacaaaggtgcgtgtccgcgcgctgagtaatgggataggagatgccaataacaggctcgcccatgagtagagcatggactgcggtgcatgtgacttcggtcaccaggggcatagcattgctcacccctgaatcaagtcatcgagacttctctgacctctgaagtgcactgtggttgcgtggctgggaatccacgcttgaccatgtactgcttgatagagtcgcggctggccgactcatgggttaaagtcagttgacaagacac

SEQ ID NO: 1397 - DNA, 556 bp, Porcine kobuvirus
  strain KobuV/Pig-wt/ESP/P259/2017, complete1
ccctcggccccctcaccctcttttccggtgcccacccgcccgggccaccgttactccactccactccttcgggactggtttggaggaacataacagggcttcccacccctgtttacccttattccactcacccttctccttaatcaaccctatccacaccccattgactgactcctttggattttgacctcagaatgcctacctgacctcccacttgcctctcccttctcggactgccggtggtgcctggcggaaaaagcacaagtgtgttgatggctaccaaactcttacccgacaaaggtgcgtgtccgcgtgctgagtaatgggataagagatgccattgacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1398 - DNA, 555 bp, Porcine kobuvirus
  strain KobuV/Pig-wt/ESP/P437/2017, complete1
cctcggccctctcaccctcttttccggtggccacccgcccgggccaccgttactccactccactccttcgggactggtttggaggaacataacagggcttcccacccctgtttacccttattccactcacccttccccttaatcaaccctatccacaccccactgactgactcctttggtttttgacctcagaatgcctacctgacctcccacttacctctcccttttcggattgccggtggtgcctggtggaaaaagcacaagtgtgttgttggctactaaactcctacccgacaaaggtgcgtgtccgcgtgctgagtaatgggataggagatgccaataacaggctcgcccatgagtagagcatggactgcggtgcgtgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1399 - DNA, 555 bp, Porcine kobuvirus
  strain KobuV/Pig-wt/ESP/P37/2017, complete1
cctcggccctctcaccctcttttccggtggccacccgcccgggccaccgttactccactccactccttcgggactggtttggaggaacacaacagggcttcccacccctgtttacctttactccacttacctttctcctaaaccaatcctatccacaccccactgactgattcctttggattttgacctcagaatgcctacatgacctcccactcgtctctcccttcccggattgccggtggtgcctggcggaaaaagcacaagtgtgttgatggctaccaaactcctacccgacaaaggtgcgtgtccgcgtgctgagtaatgggataggagatgccattgacaggctcgcccatgagtagagcatggactgcggtgcatgtgacttcagtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgataagacac

SEQ ID NO: 1400 - DNA, 555 bp, Porcine kobuvirus
  strain KobuV/Pig-wt/ESP/P393/2017, complete1
cctcggccctctcaccctcttttccggtggccattcgcccgggccaccgttactccactccactccctcgggactggtttggaggaacacaacagggcttcccacccctgtttacccttactccacttaccaccccccttaaccaatcctatccacaccccactgactgattcctttggattttgatctcagaatgcctacttgacctcccacttgcctctcccttctcggattgccggtggtgcctggcggaaaaagcacaagtgtgttgttggctaccaaactcctacccgacaaaggtgcgtgtccgcgtgctgagtaatgggataggagatgccaatgacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1401 - DNA, 555 bp, Porcine kobuvirus
  strain KobuV/Pig-wt/ESP/C247/2017, complete1
cctcggccccctcaccctcttttccggtggccacacgcccgggccaccgttactccactccactccctcgggactggtttggaggaacacaacagggcttcccatccctgtttaccctaacttcactcacccttatccttaaccaaccctatccacaccccactgactgattcctttggattttgacctcagaatgcctacctgacctcccacttgcctctcccttttcggattgccggtggtgcctggcggaaaaagcacaagtgtgttgatggctaccaaactcctacccgacaaaggtgcgtgtccgcgtgctgagtaatgggataggagatgccattgacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgataagacac

SEQ ID NO: 1402 - DNA, 558 bp, Porcine kobuvirus
  gene for polyprotein, complete cds,strain:1
ggcttcggccctctcaccctcttttccggtggccactcgcccgggccaccgttactccactccactccttcgggactggtttggaggaacataacagggcttcccacccctgtttacccttaactccaccaaccctttccttgaattaaccctatccacaccccactgactgactcccttggattttgacctcagaatgcctacctgacctcccacttgcctctccctcctcggattgccggtggtgcctggcggaaaaagcacaagtgtgttgttggctaccaaactcctacccgacaaaggtgcgtgtccgcgtgctgagtaatgggataggagatgccaatgacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1403 - DNA, 556 bp, Porcine kobuvirus
  gene for polyprotein, complete cds,strain:1
cttcggccctctcaccctcttttccggtggccactcgcccgggccaccgttactccactccactccttcgggactggtttggaggaacataacagggcttcccatccctgtttacccttattccactcacccttcccctacaaccaaccctatccacaccccactgactgattcctttggattttgacctcagaatgcctacctgacctcccacttgcctctcccttctcggattgccggtggtgcctggcggaaaaagcacaagtgtgttgttggctaccaaactcctacccgacaaaggtgcgtgtccgcgtgctgagtaatgggataggagatgccaatgacaggctcgcccatgagtagagcatggactgcggtgcatgtgacctcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1404 - DNA, 556 bp, Porcine kobuvirus
  isolate swKoV CH441, complete genome.1
cctcggccccctcaccctcttttccggtggccacccgcccgggccaccgttacttcactccactccttcgggactggtttggaggaacataacagggcttcccaatcccctgttatccttattccaattaccctttcccttaaccaaccctatccacaccccactgactgactcctttggattttgacctcagaatgcctacctgacctcccacttgcctctcccctctcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1405 - DNA, 555 bp, Porcine kobuvirus
  isolate JXJC2015, complete genome.1
cctcggccccctcaccctcttttccggcggccactcgcccgggccaccgttacttcactccactccttcgggactggtttggaggaacataacagggcttcccatccctgtttacccttcactccaattacccttcccccaatcaaccctatccacaccccattgactgattcctttggattttgacctcagaatgcctacttgacctcccacttgccttccccttctcggactgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1406 - DNA, 661 bp, Caprine kobuvirus
  isolate 12Q108, complete genome.1
cctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 1407 - DNA, 556 bp, Porcine kobuvirus
  gene for polyprotein, complete cds,strain:1
cttcggccctctcaccctcttttccggtggccattcgcccgggccaccgttactccactccactccctcgggactggtttggaggaacacaacagggcttcccatccctgtttacccttaactccactcaccctttcctacaccaaccctatccacaccctactgattgattcctttggattttgacctcagaatgcctacccgacctcccactcgttttcctccttctcggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1408 - DNA, 554 bp, Porcine kobuvirus
  gene for polyprotein, complete cds,strain:1
cttcggccctctcaccctcttttccggtggccacccgcccgggccaccgttactccactccactccttcgggactggtttggaggaacacaacagggcttcccacccctgtttaccccgatttcatctacccttctcccgaactgaccctatccacaccccactgactaactcctttggattagacctcggaatgcctacttgacctcccacttgcctctccctttctggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgcgacttcggtcgccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1409 - DNA, 556 bp, Porcine kobuvirus
  gene for polyprotein, complete cds,strain:1
cttcggccctctcaccctcttttccggtggccacccgcccgggccaccgttactccactccactccttcgggactggtttggaggaacataacagggcttcccaatccctgttaccctttactccatttccccatcccccaaacttaccctatccacaccccactgactgattcctttggattttgacctcagaatgcctacttgacctcccactcgcctctccctctccggactgccggtggtgcctggcggaaaaagcacaagtgtgttgcaggctactaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagaattctctgacctctgaagtgcactgtggttgcgtggctgggaatccacgcttgaccatgtactgcttgatagagtcgcggctggccgactcatgggttaaagtcagttgacaagacac

SEQ ID NO: 1410 - DNA, 557 bp, Porcine kobuvirus
  gene for polyprotein, complete cds,strain:1
cttcggccctctcaccctcttttccggtggccactcgcccgggccaccgttactccactccactccctcgggactggtttggaggaacataacagggcttcctacccctgttcttccctcaattccactcacccttcccctcaaccacccctatccacaccccactgactgattcctttggattttgacctcagaatgcctacttgacctcccacttgcctctcccttttcggactgccggtggtgcctggtggaaaaagcacaagtgtgttgttggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgataagacac

SEQ ID NO: 1411 - DNA, 556 bp, Porcine kobuvirus
  gene for polyprotein, complete cds,strain:1
cttcggccctctcaccctcttttccggtggccactcgcccgggccaccgttactccactccactccctcgggactggtttggaggaacataacagggcttcccatccctgtttacccttaattctgcttaccctctccttttaccaaccctgtccacaccccactgactgattcctttggattttgacctcagaatacctacctgacctcccacttgcctctcccttctcggattgccggtggtgcctggcggaaaaagcacaagtgtgttgttggctaccaaactcttacccgacaaaggtgcgtgtccgcgtgctgagtaatgggataggagatgccaatgacaggctcgcccatgagtagagcatggactgcggtgcatgtgacttcggtcaccaggggcatagcgttgctcacccctgaatcaagtcatcgagatttctctgacctctgaagtgcactgtggttgcgtggttgggaatccacgcttgaccatgtactgcttgatagagtcgcggctggccgactcatgggttaaagtcagttgacaagacac

SEQ ID NO: 1412 - DNA, 556 bp, Porcine kobuvirus
  gene for polyprotein, complete cds,strain:1
cttcggccctctcaccctcttttccggtggccactcgcccgggccaccgttactccactccactccctcgggactggtttggaggaacataacagggcttcccatccctgtttacccttaattccacttaccctctccttttaccaaccctatccatacctcactgactgattcctttggattttgacctcagaatgcctacctgacctcccacttgcctctcccttctcggattgccggtggtgcctggcggaaaaagcacaagtgtgttgttggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1413 - DNA, 556 bp, Porcine kobuvirus
  gene for polyprotein, complete cds,strain:1
cttcggccctctcaccctcttttccggtggctactcgcccgggccaccgttactccactccactccctcgggactggtttggaggaacataacagggcttcccatccctgtttacccttaattctgcttaccctctccttttaccaaccctgtccacaccccactgactgattcctttggattttgacctcagaatacctacctgacctcccacttgcctctcccttctcggattgccggtggtgcctggcggaaaaagcacaagtgtgttgttggctaccaaactcttacccgacaaaggtgcgtgtccgcgtgctgagtaatgggataggagatgccaatgacaggctcgcccatgagtagagcatggactgcggtgcatgtgacttcggtcaccaggggcatagcgttgctcacccctgaatcaagtcatcgagatttctctgacctctgaagtgcactgtggttgcgtggttgggaatccacgcttgaccatgtactgcttgatagagtcgcggctggccgactcatgggttaaagtcagttgacaagacac

SEQ ID NO: 1414 - DNA, 556 bp, Porcine kobuvirus
  gene for polyprotein, complete cds,strain:1
cttcggccctctcaccctcttttccggtggccactcgcccgggccaccgttactccactccactccctcgggactggtttggaggaacataacagggcttcccatccctgtttacccttggttccactcaccctttcccctcaccaaccttatccacaccccactgactgactcctttggattttgacctcagaatgcctacttgacctcccactcgcctctcccttctcggactgccggtggtgcctggcggaaaaagcacaagtgtgttgttggctaccaaactcctacccgacaaaggtgcgtgtccgcgtgccgagtaatgggataggagatgccaataacaggctcgcccatgagtagagcatggactgcggtgcatgtgacttcggtcaccagggacatagcattgctcacccctgaatcaagtcatcgagaattctctgacctctgaagtgcactgtggttgcgtggctgggaatccacgcttgaccatgtactgcttgatagagtcgcggctggccgactcatgggttaaagtcagttgacaagacac

SEQ ID NO: 1415 - DNA, 558 bp, Porcine kobuvirus
  gene for polyprotein, complete cds,strain:1
cttcggccctctcaccctcttttccggtggccactcgcccgggccaccgttactccactccactccctcgggactggtttggaggaacacaacagggcttcccacccctgttctttccttaattccactcaccctttccctttaccaaccctatccacaccccactgactgattcctttggattttgacctcagaatacccatttgacctcccacttgcctctccctttttcggattgccggtggtgcctggcggaaaaagcacaagtgtgttgttggctaccaaactcctacccgacaaaggtgcgtgtccgcgtgccgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgataagacac

SEQ ID NO: 1416 - DNA, 555 bp, Porcine kobuvirus
  isolate OH/RV50/2011, complete genome.1
cctcggccccctcaccctcttttccggtggccacccgcccgggccaccgttacttcactccactccctcgggactggtttggaggaacataacagggcttcccatccctgtttacccttatttccaattaccctttcctaaaccaaccctatccacaccccactgactgactcctttggattttgacttcagaatgcctacctgacctcccacttgcctctcccttctcggactgccggtggtgcctggcggaaaaagcacaagtgtgttgttggctaccaaactcctacccgacaaaggtgcgtgtccgcgtgctgagtaatgggataggagataccaataacaggctcgcccatgagtagagcatggactgcggcgcatgtgacctcggtcaccaggggcatagcattgctcacccctgaatcaagtcatcgagacttctctgacctctgaagtgcgctgtggttgcgtggctgggaatccacgcttgaccatgtactgcttgatagagtcgcggctggccgactcatgggttaaagtcagttgacaagacac

SEQ ID NO: 1417 - DNA, 557 bp, Porcine kobuvirus
  gene for polyprotein, complete cds,strain:1
cttacggccctctcaccctcttttccggtggccattcgcccgggccaccgttactccactccactccctcgggactggtttggaggaacacaacagggcttcccatccctgtttatcctaattctacttaccttttcccttttaccgaccctatccacaccccactgactgattcctttggattttgacctcggaatgcctactagatctcccacttgcctctcccttcccggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1418 - DNA, 555 bp, Kobuvirus pig/JY-2010a/CHN
  isolate Y-1-CHI, complete genome.1
cctcggccccctcaccctcttttccggcggccactcgcccgggccaccgttacttcactccactccctcgggactggtttggaggaacataacagggcttcccatccctgtttacccttactctgacaacccttccccttaatcaaccctatccacaccccactgactgactcctttggattttgacctcagaatgcctacttgacctcccacttgcctctccctcctcggattgccggtggtgcctggcggaaaaagcacaagtgtgttgcaggctaccaaactcctacccgacaaaggtgcgtgtccgcgtgctgagtaatgggataggagatgcctacaacaggctcgcccatgggtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1419 - DNA, 420 bp, Bovine kobuvirus; identical to SEQ ID NO: 460
  polyprotein gene, complete cds.1

SEQ ID NO: 1420 - DNA, 555 bp, Porcine kobuvirus
  strain KobuV/Pig-wt/ESP/P461/2017, complete1
cttcggccctctcaccctcttttccggtggccacccgcccgggccaccgttactccactccactccctcgggactggtttggaggaacacaacagggcttctcatccctgtttacccttattccacttacccttctccccgaactacccaacccactccccactgattgactcccttggattaagacctcggaatgtcttcctgaccttcttcttggttttcccttttcggattgccggtggtgcctggtggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1421 - DNA, 557 bp, Porcine kobuvirus
  gene for polyprotein, complete cds,strain:1
cttcggccctctcaccctcttttccggtggccacacgcccgggccaccgttactccactccactccctcgggactggtttggaggaacacaacagggcttcccatccctgttcctccctcaactccacttaccctttccccttaccaaccttatccacaccctattgactgattcctttggattttgacctcagaatgcctatctgacctcccacctgcctcccccttctcggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcagtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1422 - DNA, 557 bp, Porcine kobuvirus
  gene for polyprotein, complete cds,strain:1
cttcggccctctcaccctcttttccggtggccacacgcccgggccaccgttactccactccactccctcgggactggtttggaggaacacaacagggcttcccatccctgttcctccctcaactccacttaccctttccccttaccaacctcatccacacctcattgactgattcctttggattttgacttcagaatgcctatctgacctcccacttgcctcccccttctcggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcagtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1423 - DNA, 556 bp, Porcine kobuvirus
  gene for polyprotein, complete cds,strain:1
ttcggccctctcaccctcttttccggtggccacacgcccgggccaccgttactccactccactccctcgggactggtttggaggaacacaacagggcttcccatccctgttcctccctcaactccacttaccctttccccttaccaacctcatccacacctcattgactgattcctttggattttgacttcagaatgcctatctgacctcccacttgcctcccccttctcggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcagtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1424 - DNA, 557 bp, Porcine kobuvirus
  strain CH/KB-1/2014, complete genome.1
cttcggccctctcaccctcttttccggtggccacccgcccgggccaccgttacttcactccactccttcgggactggtttggaggaacataacagggcttcccaatcccctgttatcctttatcccaaacaccttttcccttaaccaaccctatccacaccccactgactgattcctttggattttgacctcagaatgcctacctgacctcccactcgcctctcccttctcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1425 - DNA, 557 bp, Porcine kobuvirus
  genomic RNA, complete genome,strain:1
cttcggccctctcaccctcttttccggtggccactcgcccgggccaccgttactccactccactccctcgggactggtctggaggaacacaacagggcttcccatccctgtttaccctcattccaatttacccttcccttacaaccaaccctatccacaccccactgaatgattcctttggattttgacctcagaatgcctacctgaccccccacttgcttctccctcctcggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcggtcaccagggacatagcattgctcacccctgaatcaagttattgagatttctctgacctctgaagtgcactgtggttgcgtggccgggaatccacgcttgaccatgtactgcttgatagagtcgcggctggccgactcatgggttaaagtcagttgacaagacac

SEQ ID NO: 1426 - DNA, 559 bp, Porcine kobuvirus
  isolate JS-02a-CHN/2014/China, complete genome.1
cggcctcggcccactcaccctctttaccggtggccacccgcccgggccaccgttacttcactccactccttcgggactggtttggaggaacataacagggcttcccatccctgttcaccccttattccaattaccctcacccttgattaaccctacccacaccccactgactgattcctttggattttgacctcagaatgcctacttgacctcctacttgcttctcccttctcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1427 - DNA, 556 bp, Porcine kobuvirus
  isolate CH/DX/2012, complete genome.1
cttcggccctctcaccctcttttccggtggccactcgcccgggccaccgttacttcactccactccctcgggactggtttggaggaacataacagggcttcccacccctgtttacccttaattccacttacccttccccttaaccaaccctatccacaccccactgactgattcctttggattttgacctcagaatgcctacttgacctcccacttgcctctcccttctcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1428 - DNA, 556 bp, Porcine kobuvirus
  isolate CH/HZ/2011 polyprotein gene, complete1
cttcggccctctcaccctcttttccggtggccactcgcccgggccaccgttacttcactccactccctcgggactggtttggaggaacataacagggcttcccacccctgtttacccttaattccacttacccttccccttaaccaaccctatccacaccccactgactgattcctttggattttgacctcagaacgcctacttgacctcccacttgcctctcccttctcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1429 - DNA, 556 bp, Porcine kobuvirus
  gene for polyprotein, complete cds,strain:1
cctcggccctctcaccctcttttccggtggccactcgcccgggccaccgttacttcactccactcccttgggactggtttggaggaacacaacagggcttcccacccctgtttaccctacactccactcaccctctcccttaaccaaccctatccacatcccactgactgattcctttggattttgacttcagaatgcctacttgacctcccacttgcttctcccttcccggattgccggtggtgcctggcggaaaaagcacaagtgtgttgttggctaccaaacccctacccgacaaaagcgcgtgtccgcgtgctgagtaatgggataggggatgccaatgacaggctcgcccatgagtagagcatggactgcggtgcatgtgactttggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1430 - DNA, 557 bp, Porcine kobuvirus
  gene for polyprotein, complete cds,strain:1
cttacggggctctcaccctcttttccggtggccactcgcccgggccaccgttactccactccactccttcgggactggtttggaggaacacaacagggcttcccacccctgtttacccttaactccactcacccctcccttgaaccaaccctatccacaccccactgactgactcctttggattttgacttcggaatgcctacctaacctcccacttgcctttccctttacggattgccggtggtgcctggcggaaaaagcacaagtgtgttgttggctaccaaactcctacccgacaaaggtgcgtgtccgcgtgctgagtaatgggataggagatgccaatgacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1431 - DNA, 776 bp, Kobuvirus sp.
  sheep/TB3/HUN/2009, complete genome.1
cttcggccccctcaccctcttttccggcggcgcaagttcgcgtcgtcgtaagcctggacacccatgttcgcatcggtctccgggcaaatacaagaaccccagaccttctggtacttcttcgcctgggtcacaaaagcgaagaacctgcctctctaacgccagacgagcggcattaaacttgaacttctggcactctccactctcccttttccctgtccctttccccactgcgctctcaaggtcgcgcaatcctgggactagcccagttttaaaagttcctggcaccctttgcccctctaggcccttaaggtaggaactgaccttgtgctgtgatctcggtgcgggagtgctaccacgtagtcatcgtaagcctcgtttctggttctgccctggcaaggctacagagtaccgtgttccgctgtggatgccatccgggtaaccggacccccagtgtgtgtagcggtatgttcacggtccgccgtgttcaccagattcctgacctggctttgctagaaatggtgtgtgcccaatccctgtgaccagtatcaattacatcacctaggaatgctaggaaggtaccccagtcctgagctgggatctgatcctaggctaattgtctacggtgatgctccttttattttcttacaactgctattgactgtctgattgctgattctgctcttgtgctcttctgctctggctcattctcaagggttctctttgtccaagatcctttggttctctccttgttccacttgccactgccaacgcttgtc

SEQ ID NO: 1432 - DNA, 665 bp, Caprine kobuvirus
  isolate MN1/2018, complete genome.1
gcccgtccccctcaccctcttttccggtggccacgcccgggccaccgatacttcccttcactccctcgggactgttggggaggaacacaacagggctcccctgtatttcctcttcccattccccctttcctaaccccaaccgccgtatctggtggcggtaagacacacgggtctttccctctaaagcacaattgtgtgtgtgtcccaggtcctcctgcgttcggtgcgggagtgctcccacccaactgttgtaagcctgtccaacgtgtcgtcctggcaagactatgacgtcgcatgttccgctgtggatgccgaccgggtaaccggttccccagtgtgtgtagtgcgatcttccaggttctcctggttggcgttgtccagaaactgcttcgggtaagtggggtgtgcccaatccctacaagggttgattctttcaccaccttaggaatgctccggaggtaccccagcaacagctgggatctgaccggaggctaattgtctacgggtggtgtttccattttctttttcacacaacttcattgctgacaactcactgactaatcacttgctctcttgtgcctttctgctctggttcaagttccttgattgtttgtttgattgcttttcactgctttcttcccacaatccttgctcagttcaaagtc

SEQ ID NO: 1433 - DNA, 556 bp, Porcine kobuvirus
  gene for polyprotein, complete cds,strain:1
cttcggccctctcaccctcttttccggtggccgcccgcccgggccaccgttacttcactccactccctcgggactggtttggaggaacacaacagggcttcccatccctgttttcccttaataccacttaccttttccctaattaaccctacccaccacccaccgactgactccctttggattttgacctcagaatgcccacttgacctcccacttgcctcttcctttttggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacctcggtcaccacgggcatagcattgctcacccgtgaatcaagtcatcgagatctctctgacctctgaagtgcactgtggttgcgtggctgggaatccacgcttgaccatgtactgcttgatagagtcgcggctggccgactcatgggttaaagtcagttgacaagacac

SEQ ID NO: 1434 - DNA, 549 bp, Porcine kobuvirus
  gene for polyprotein, complete cds,strain:1
cctctcaccctcttttccggtggccacccgcccgggccaccgttactccactccactccttcgggactggtttggaggaacataacagggcttcccacccctgtttacccttattccactcaccctttccccacaaccaaccctatccacaccccactgactgattcctttggattttgacctcagaatgcctacctgacctcccacttgcctctcccttctcggattgccggtggtgcctggcggaaaaagcacaagtgtgttgttggctaccaaactcctacccgacaaaggtgcgtgtccgcgtgctgagtaatgggataggagatgccaatgacaggctcgcccatgagtagagcatggactgcggtgcatgtgacctcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1435 - DNA, 546 bp, Porcine kobuvirus
  gene for polyprotein, complete cds,strain:1
ctcaccctcttttccggtggccactcgcccgggccaccgttactccactccactccctcgggactggtttggaggaacacaacagggcttcccatccctgtttacccttcactccactcaccccttcccttaatcaaccctgtccacaccccactgactgattcctttggattatgacctcagaatgcctacccgatctcccactcgcctctcctttcttggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1436 - DNA, 755 bp, Bovine kobuvirus; identical to SEQ ID NO: 1218
  strain BKoV/EGY-1, complete genome.1

SEQ ID NO: 1437 - DNA, 729 bp, Bovine kobuvirus; identical to SEQ ID NO: 922
  strain SC1 polyprotein gene, complete cds.1

SEQ ID NO: 1438 - DNA, 787 bp, Aichivirus B
  genomic RNA, complete genome,strain:U-1.1
cttcggccccctcaccctcttttccggcggcgcatgttcgcgtcgtcgtaagtctggattcccaaggcccactcggttcaacttcggtttccggacaaatacaaagaacctcagtcctcttggtactttctcgcctgagtctacaaagcgagaaacctgcccctctaacgccagacgagcggcataaaactcgaacttctggcacgttccaccaccccttctcctatcccaacccccattgcgctctcaaggtcgcgcttttccgagactagctcggattcaaaaagttcctggcaccctttaccccttcaggcccttaaggtaggaactgaccttgtgctgtgatctcggtgcggaagtgctactgcgtagtgattgtaagatccttttgtggttctgccctggcaaggctacagagtgctgtgatccgctgcggatgccatcctggtaacaggacccccagtgtgcgcaacagtatgttcacggtcttccgtgttcaccacattcggaacactgctttcgtgaaacagtgtgtgtccaatccctgtgatcagtatcaaccacaccacctaggaatgctaggaaggtaccccggttcgccgggatctgatcctaggctaattgtctacggtggtgctcctttttattttccacttcaactcactggttacaactgcttgatttctgtgtttgctgcttttctctgctctcactgccattctcaagtgttcacactgtccaagctcctttggttgttcgcttccacttgccactgtcaactcttgtc

SEQ ID NO: 1439 - DNA, 770 bp, Bovine kobuvirus; identical to SEQ ID NO: 1230
  strain IL35164, complete genome.1

SEQ ID NO: 1440 - DNA, 545 bp, Caprine kobuvirus
  isolate CKoV-China/SWUN/F11/2019, complete1
cccccttttccctaaccccaaccgccgtatctggtggcggcaagacacacgggtctttccctctaaagcacaaatgtgtgtgtgtcccaggtcctcctgcgctcggtgcgggagtgctcccacccaactgttgtaagcctgtccaacgtgtcgtcctggcaagactatgacgtcgcatgttccgctgcggatgccgaccgggtaaccggttccccagtgtgtgtagtgcgatcttccaggttcccctggttggcgttgtccagaaactgcttcaggtaagtggggtgtgcccaatccctgcaaaggttgattctctcaccaccttaggaatgctccggaggtaccccagcaacagctgggatctgaccggaggctaattgtctacgggtggtgtttcctttttctttttccacaacttcattgctgacaactcactgactacccatttgctctcttgtgcctttctgctctggttcaagctccttgattgtttttgattgctttctattgctttcttccactcaacccttgctcagttcaaagtc

SEQ ID NO: 1441 - DNA, 782 bp, Kobuvirus sp.
  cattle/Kagoshima-2-24-KoV/2015/JPN genomic RNA, complete1
ataccctccccctccacactcttttcgacggcgcgcctcggcaaggccgccgataccgcactgtgctacttcggtaccactctgcgggaatgacaatatgcccggtgtatagtttgcctgtttctcgcaccgttaccgctcgttcgggaatgtgaaactggcacccctcctctcccctaccaccctttctccttcgcccccattcataatttacaacgccgcacacagcggcggccgccaagggctagcctggcggttataaaaggaacctgggtctttccctcttcaagccaaaaggtaggttccctgtgtccctgaatgctcggtgaggaatgctgcaccgtaacgctttgtgaagtgtttgcaagttctggcccggcaagcctacagagtgctgtgatccgctgcggacgccatcctggtaacaggacccccagtgtgcgcaacagtatgttcagacttcggtttgttcacttgctttcatggaccattgcgcgaaagtgcgtgcgccatatccctgtacttcaggtgtgcttctctggaccctaggaatgctgcgaaggtaccccgtttcggcgggatctgatcgcaggctaattgtctatgggttcagtttcctttttctttactccacaattgactgcttaactgactctggatcttgtgcttccactgctctttctgctctcaaaacggcttcacttaccaactctcacctttcgaccaacaccatttacacactaacttttttcgactcttctgactcctggcttggtgaagac

SEQ ID NO: 1442 - DNA, 537 bp, Porcine kobuvirus
  THA/2007 gene for polyprotein, complete cds,1
ttttccggtggccacacgcccgggccaccgttactccactccactccttcgggactggtttggaggaacacaacagggcttcccacccctgtttaccctttctccactcatccactccctttaaccaaccctgtccacaccccactgactgactcctttggattttgacctcggaatgcctacttgaccttccactcgcctttcccttttcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1443 - DNA, 528 bp, Porcine kobuvirus
  gene for polyprotein, complete cds,
  strain:1
gccacacgcccgggccaccgttactccactccactccctcgggactggtttggaggaacacaacagggcttcccatccctgttcctccctcaactccacttaccctttccccttaccaaccttatccacaccctattgactgattcctttggattttgacctcagaatgcctatctgacctcccacctgcctcccccttctcggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcagtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1444 - DNA, 532 bp, Porcine kobuvirus
  gene for polyprotein, complete cds,
  strain:1
ccggtggccacccgcccgggccaccgttactccactccactccctcgggactggtttggaggaacataacagggcctcccacccctgttcaccttaattccacttaccctttccctcaaccaaccctatccacaccccattgactgattcctttggattttgacctcagaatgcctacttgacctcccacttgcctttcccttctcggattgccggtggtgcctggcggaaaaagcacaagtgtgttgcaggctatcaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1445 - DNA, 510 bp, Porcine kobuvirus
  isolate Chgz1 polyprotein gene, complete cds.1
cgttactccactccactccctcgggactggtttggaggaacataacagggcttcccacccctgtttacccttaattccactcaccctttccctataaccaaccctatccacaccccactgactgattcctttggattttgacctcagaatgcccacctgacctcccacttgcctctcccttcccggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgactttggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1446 - DNA, 513 bp, Porcine kobuvirus
  isolate XX, complete genome.1
ccaccgttacttcactccactccctcgggactggtttggaggagcataacagggcttcccatccctgttcaccctcaataccacccaccctttccctcaaccatccctatccacaccccactgactgattcccttggattttgacctcagaacgcctacttgacctcccacttgcctttcccttctcggattgccggtggtgcctggcggaaaaagcacaagtgtgttgcaggctaccaaactcctacccgacaaaggtacgtgtccgcgtgctgagtaatgggataggagatgcctacaacaggctcgcccatgagtagagcatggactgcggtgcatgtgacttcggtcaccacgggcatagcattgctcacccgtgaatcaagtcattgagattcctctgacctctgaagtgcactgtggttgcgtggctgggaatccacgcttgaccatgtactgcttgatagagtcgcggctggccgactcatgggttaaagtcagttgataagacac

SEQ ID NO: 1447 - DNA, 509 bp, Porcine kobuvirus
  isolate Chgz2 polyprotein gene, complete cds.1
cgttactccactccactccctcgggactggtttggaggaacataacagggcttcccacccctgtttacccttaattccactcaccctttcccttaaccaaccctatccacaccccactgactgattcctttggattttgacctcagaatgcccacttgacctcccacttgcctctcccttcccggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgactttggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1448 - DNA, 509 bp, Porcine kobuvirus
  isolate Chgz3 polyprotein gene, complete cds.1
cgttactccactccactccttcgggactggtttggaggaacataacagggcttcccatccctgtttaccctttattccacttaccctttctcctaatcaaccctatccacaccccactgactgactcctttggattttgacctcagaatgcctacttgacctcccacttgcctctcccttctcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgataagacac

SEQ ID NO: 1449 - DNA, 641 bp, Grey squirrel kobuvirus; identical to SEQ ID NO: 770
  isolate UK 2010 polyprotein gene, complete1

SEQ ID NO: 1450 - DNA, 510 bp, Porcine kobuvirus
  isolate Chgz5 polyprotein gene, complete cds.1
cgttactccactccactccctcgggactggtttggaggaacataacagggcttcccacccctgtttacccttaactccactcaccctttccctacaaccaaccctatccacaccccactgactgattccttcggattttgacctcagaatgcctacctgacctcccacttgcctttcccttcccggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgcggctgggaatccacgcttgaccatgtactgcttgatagagtcgcggctggccgactcatgggttaaagtcagttgacaagacac

SEQ ID NO: 1451 - DNA, 509 bp, Porcine kobuvirus
  isolate Chgz4 polyprotein gene, complete cds.1
cgttactccactccactccctcgggactggtttggaggaacataacagggcttcccatccctgtttaccctaaattccacttaccctttccctagaccaaccctatccacaccccactgactgattcctttggattttgacctcagaatgcctacctgacctcccatctgcttttccctttccggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 1452 - DNA, 1000 bp, Cardiovirus B; identical to SEQ ID NO: 138
  strain rat08/rCaB/HUN, complete genome.1

SEQ ID NO: 1453 - DNA, 977 bp, Unknown
  Description of Unknown: Theiler's-like virus of rats NGS910 genomic RNA, complete genome.1 sequence
caccccctttggacgcggggcctgcgatagtgccaccccccgtcctccctattccaactacccgaccctaacccagggtccaggaaactggatcaatacaagtcatcccctgaatgctggctaatcagaggaaagtcagcattttccggcccaggctaagagaaacacaataagttagaatctaaattaatccccttgacgaattcgcaacgataagtcctccctcccttgccgctcgttcacacccagaactaacaattcggccccttgtgacgagccccttggtgaaaggacctctttcaatgcgacgtggttggagattaaaccgactccgacgaaagtgctatcatgcctccccgattatgtgatgttttctgccctgctgggcggagcattctcgggttgatacaccttgaatccttcatccttggacctcaggtcccccggtctaagccgcttggaatacgacagggttattttccaatcttctcctttctactttcatgagtcctattcatgaaaagggtctgtgctgccccttccttcttggagaatctgcgcggcggtctttccgtctctcgaaaagcgcagatgcagcatgctggaaccggtgaagaaaacagttctttgtggaaacttagagcagacatcgaaacagctgtagtgacctcacagtagcagcggaaccccctcctggtaacaggagcctctgcggccaaaagccccgtggataagatccactgctgtgagcggtgcaaccccagcaccctggttcgatggttgttctctgtggaaccagagaatggtctttctcaagccctccagtagagaagccaagaatgtcctgaaggtaccccgcatgcgggatctgatcaggagaccaatcgtcagtgctttacactggcgctttggtttaaaaactgtcacagcttctccaaaccaagtggtcttggttttcacttttatcaaactgtttc

SEQ ID NO: 1454 - DNA, 1000 bp, Bovine viral diarrhea virus
  nonstructural proteins (p125/p80, p20)1
ggagggaaggcgattcgtcgccagcttatttatctccgctctggcaacctacacatacaagacttggaattaccacaacctctccaaggtagtagaaccagccttggcatacctcccctacgctaccagtgcactaaaaatgttcaccccaactaggctggagagcgtagtcatacttagcaccacaatatacaaaacttacctctcaataaggaaaggaaaaagtgatggacttctgggtacagggattagtgcagcaatggagattctgtcacagaacccggtgtcagtaggtatatctgtcatgctgggggtgggggcaattgccgctcacaatgcaatcgagtctagtgagcaaaaaaggaccctattgatgaaagtgtttgtaaaaaacttcctggaccaggcggcaacagatgagttggtgaaggaaaatccagagaaaataataatggccttatttgaagcagtacagacaattggcaacccattgaggcttatatatcatctgtatggggtttactacaaaggctgggaagcgaaagaactatccgagaggacagctggcaggaacctgttcactttgataatgttcgaagctttcgaactattagggatggactctgaagggaagataaggaacctatctgggaattacatcttggatttgatctacagtttacataaacagataaacagaggcttgaagaagatagtcttggggtgggctcctgcacccttcagttgtgactggactcctagtgatgggagaatcaggttacccacagacaactatctgagagtagagactaagtgcccatgtggttatgagatgaaagcactaaggaatttcagtggcagtctcacaaaagtggaagagaaagggcctttcctctgtaggaacgggcctggtagggggccagttaactatagagtcacaaagtactatgatgacaacctcacagagataaaaccagttgcaaaactagaaggactgcac

SEQ ID NO: 1455 - DNA, 1000 bp, Boone cardiovirus 1
  isolate BCV-1 polyprotein gene, complete cds.1
ggtttggatcttggatctctctccttccttcccccgtcttcaatttagcttcgtgattgaagcatctcactgtctctagtatttatgtcggactgacgattgagtacgttcagattgtgtttgggaggcccaagggatcgatggacaacacttcgaaagagtcacttgtccaccgctcctttcccctaccctagcaactctggatttgctcacgtggagttcgaggtctgtactttaactctgacttgcttttcttaccttgctatcttgctgacgtggattggttgtagactgattcacgttctcgttagatgctgacgtggagtacgatcgctgtacattccactactgccaattagctcccccttcccgttgctcccctctataaggagagccttctcttgcaaaggtgaagccttcacccccggtcgaagccgcttggaataagacagggttattttctcctctcctcggcgcttgcctcttctaagctgaataggttctatctattcaggcggatggtctggtccgttccttcttggacagagtgtgtatctgggttttccggatctcgaccacacactcaccagagctcaggagtgattaagtcaaggcccgatctgcggcgaaaaggaaatgaagtattttgcagctgtagcgacctctcaaggccagcggatttccccacctggtgacaggtgcctctggggccaaaagccacgtgttaatagcacccttgagagcggtggtaccccaccaccctgcaaattatggatttgacttagtaactaaaagattgacttggcatacctcaacctgagcggcggctaaggatgccctgaaggtacccgtgttgaaatcgcttcggcgaccatggatctgatcaggggccctgcctggagtggttctatcccacacagcgtagggttaaaaaacgtctaaccgccccacaaagaccccggcagggatgccggtttcctttttaccaattcttgacact

SEQ ID NO: 1456 - DNA, 1000 bp, Miniopterus schreibersii picornavirus 1
  complete genome.1
atcacctgcttagggcgaattgtcgagacgtcattgatgttccggcccaggataacaacgaagtgttccaaggtgatttactccgcccttttaacaacgcacttgggcgaactgcactggtgtactggtaattcctgtcttggattgtgtagtggatataaactgtacccacggttgaaacccactactcacctcacagattgtgtttacctttatatctttgtacgcggtaagtgcggcgttgagagcgccttgtaagttcctaagcattagttggtcctccccgattatgtcatcaatggggttgtcggcacgcggttaagcggttgtcgacccgttgcttggtttaagcatgaggtggattcccccgattatgtctacccgttactatggcgggcggtcgtttcagggtgtttctactgaggactgcaccaagtctttatcttttattctcagatctccggctgtttgacgcttgtaggacagcaggactattttctcttaatctttttctacccactagggtcctatcctagtggagggagggtgccaccccttctctctttagagagtgcgcctggcggtctttccgtctctggaaaaaggagcacatggcatgctacaattggcacaagaaaacaagctttgcggattctttctttgtactagaggaagctgtagcgaccctgtatggcgagcggactcccctctcggcgacgagagcctctcgggccaaaagccaagtgttaatagcacccatacaggcggcagtaccccactgccctttctcaacatacaatgactgatgaaccactgttggtttttctgacacctttgtagtaggattccaaggaatgtcctgaaggtaccctgttagcttacgcgcaggatctgatcaggagtctctttacagtgctgtacactgtgcaagggattaaaaattgtttgaggaatccccgagatagtggtctatctcttcctattttgttttacagacacg

SEQ ID NO: 1457 - DNA, 1000 bp, Rodent cardiovirus
  isolate AMzj-2018, complete genome.1
cagtacccgcgtccaaagggggttgcctggggtggtctcaaccgcgaacacactagcgtgtatccgcggtgaagaccccagggccccctttggacgcgggtactgcgacagtgccaaaccccgtccttccctactccacctaccccggccctaacccagggtccaggaaactggatcaatacaaatcatcccctgaatgctggctaatcagaggaaagtcagcattttccggcccaggctaagagaaatacataagttagactcaatcttgatccccttgacgaattcgcaacgaaaagttctccctcccttgccgcttgttcacacccagaactaataattcggcccctcgtgacaagcccctcggtgaaagaacctctttcaatgcgacgtggttggagattaaatccgactccgacgaaagtactatcatgcctccccgattatgtgatgttttctgccctgctgggcggagcattctcgggttgatatactttgaatccttcctccttggacctccggtcccccggtctaagccgcttggaatacgacagggttattttccaaatctttctccttctactttcatgagctctattcatgaaaagggcatgtgctgccccttccttcttggagaatccgcgcggcggtctttccgtctctcaaaaagcgtggatgcagcatgctggaaccggtgaagaatgtagttctttgtggaaacctagagcagacatcgaaccggctgtagcgacctcacagtaccactgctgtgagcggtgcgaccccagcaccctggttcgatggttgttctctgtggaaccagagaatggccttctcaagccatccagtagagaagccaagaatgtcctgaaggtaccccggcccacgggatctgatcaggagactgatttgtggtgctttacaccacaacttcagtttaaaaattgtcacagcttctccaaaccaagtggtcttggttttccctctattacaatgtgac

SEQ ID NO: 1458 - DNA, 1000 bp, Foot-and-mouth disease virus
  - type O,strain Akesu/58, complete1
cgacagctcctgcgttgcactccacacttacgtttgtatgcgcgcgggaaccgctggactttcgttcacccacctacagctggactcacggcaccgcgtggccattttagctggactgtgcggacgaacgccacttgcgcaccccgcgtgactggttaatactcttaccactttccgcctacttggtcgttagcgctgccctgggcactcccgttgggggccgtccggtgctccacggttcccacgcatgacaaactacggtgatggggccgcttcgtgcgagttgatcgcctggtgtgtttcggctgtcacccgaagcccgcctttcacaagttttaccgtcgttcccgacgttaaagggaggtaaccacatgcttattaccgcctttcccggcgttaaagggctgtaaccacacgaattgccttcacccggaagtaaaacggaaatccacacacacggttttgcccgttttcagagagaaacgggacgtgagcgcacgaaacgcgccgtcgcttgtggaagacttgtacaaacacgatctacgcaggtttcctcaactgacacaactcgtgcaaactgtaaccccgcctggtctttccaggtctggaggggaagcttttgtactgtgtttggctccacgttcggtctactggcgagcgctagtagtggcaatgttgtttcgtagcggagcatgttggccgtgggaatccctccttggcgacaaggacccacggggccgcaagccacgtctttgacccaacatgtgtgcaaccccagcacggcaaccttgccacgaaaaccacttcaaggtaacactgatactggtactcaaatactggtgacaggctaaggatgcccttcaggtaccccgaggtaacacgggacacttgggatctgagaaggggattgggacttctataaaagtgcccaatttaaaaagcttctatgcctgaataggtgaccggaggccggcacctttcctctacaactactttacca

SEQ ID NO: 1459 - DNA, 1000 bp, Rodent Cardiovirus
  isolate 1, complete genome.1
ccgcgggagagatccccggggccccctttcaacgcgggtactgcgatagtgccaccccagccttatccttctcccgacttcccgaccctaacccaggttcctcggaaaggaacaccaaaactcaatcccctggatgctgactaatcagaggaaagttggcattttccggcccaggcttagagaagtagataagttagactcaaattgattcaattccccttggcgaatccgcgtcgaggcgccacctctcacttgccgtcctccacacccatccttaattcggcctctgtgttggaccccttgttgaagtggcttccctctgcgcggcgcggttggagaattttgtcatccgactccgacgaaactaccatcatgcctccccgattgtgtgatgccctccgccctgctgggtggagcatcctcgggttgagaaacctcttccttcaaccttggaccccggtcccccggtctaagccgcttggaataagacagggttattttcactctcttcttcttctactccacggatttctattccctggaagggtatgtgttgcccctcgcttcttgcggaacgcgcacggtggtctttccacctctcgaaaagtgtgcgtgcaacatgcagagatacgtgaagaaagcagtttgtgaactagtcctagagcgaacacgaatccggctgtagcgaccacttaagagcagcggaacccccctcccggcgacgggagcctctgcggccaaaagccacgtggataagatccactcttgagtgcggtgcggccccggcaccccggtttcgtggttgttctttgacgaacccacaaatggcgatcttaagcgcctctgtagagaagccaagaatgtccagaaggtacccctatcaagggatctgatctggagacgtgtcacttatgctttacacgagtgctcgcgtttaaaaactgtcacagcttctccaaaccaagtggtcttggttttctccttctaattctctgtcaat

SEQ ID NO: 1460 - DNA, 1000 bp, Unknown
  Description of Unknown: Theiler's encephalomyelitis virusstrain DA, complete genome.1 sequence
tcccccggtcaccccctttcgacgcgggtactgcgatagtgccacccagtctctcctactcccgactcccgaccctaacccaggttcctcggtataggaacaccactttactcatcccctggatgctgactaatcagaggaacgtcagcattttccggcccaggctaagagaagtagataagttacaatccaaattgatttatcatccccttgacgaattcgcgttggaaaagcacctctcacttgccgctcttcacacccatcattttaattcggcctctgtgttgagccccttgttgaagtgtttctctccatcgcgacgtggttggagatctaagtcaaccgactccgacgaaactaccatcatgtctccccgattatgtgatgctttctgccctgctgggtggagcatcctcgggttgagaaatccttcttcctttcaccttggaccccggtcccccggtctaagccgcttggaataagacagggttattttcacctctttttcttctactccacagtgctctatactgtggaagggtatgtgttgccccttccttcttggagaacgtgcgcggcggtctttccgtctctcgacaagcgcgcgtgcaacatgcagagtaacgcgaagaaagcagttcttggactagctttagtatctgcaagaagacagctgtagcgaccacacaaaggcagcggaacccccctcctggtaacaggagcctctgcggccaaaagccacgtggataagatccacctttgtgtgcggtgcaaccccagcaccctggtttcttgaagatactctagtgaacccttgaatggcaatctcaagcgcctctgtaggaaagccaagaatgtccaggaggtacccctacctcgcggaagggatctgacctggagacacgtcgcaagtgctttacacctgtgctcgtgtttaaaaattgtcacagctttcccaaaccaagtggtcttggttttcctttttattactattgacact

SEQ ID NO: 1461 - DNA, 1000 bp, Unknown
  Description of Unknown: Theiler murine encephalomyelitis, complete genome.1
ccggttaccccctttcgacgcgggtactgcgatagtgccaccccagtccttcctactcccgactcccgaccccaacccaggttccttggaacaggaacaccaatttattcatcccttggatgctgactaatcagaggaacgtcagcattttccggcccaggctaagagaagtagataagttagaatctaaattatttatcatccccttgacgaattcgcgttggaaaagcacctctcacttgccgctcttcacacccatcattctaattcggcccctgtgttgagccccttgttgaagtgtttccctccatcgcgacgtggttggagatctaagttaaccgactccgacgaaactaccatcatgcctccccgattatgtgatgctttctgccctgctgggtggagcatcctcgggttgagaaatctttcttccttttaccttggactccggtcccccggtctaagccgcttggaataagacagggttatcttcactcctcttcttttctacttcacagtgttctatgctgtgaaagggtatgtgtcgccccttccttcttcggagaacacgcgtggcggttttttccgtctctcgacaagcgcgtgtgcgacatgcagagtctcgcgaagaaagcagttctcggtctagctttagtgcccacaagaaaacagctgtagcgaccacacaaaggcagcggaacccccctcctggtaacaggagcctctgcggccaaaagccacgtggataagatccacctttgtgtgcggtgcaaccccagcaccctgttttcttggtgacactctagtgaacccctgaatggcgatcttaagcgcctctgtagggaagccaggaatgtccaggaggtaccccttccgctcggaagggatctgacctggagacacatcacatgtgctttacacctgtgcttgtgtttaaaaaattgtcgcagcttccccaaaccaagtggtcttggttttctctttttattatattgtcaat

SEQ ID NO: 1462 - DNA, 1000 bp, Unknown
  Description of Unknown: Theiler's encephalomyelitis virus, complete genome.1 sequence
atcccccggttaccccctttcgacgcgggtactgcgatagtgccaccccagtctttcctactcccgactcccgaccctaacccaggttcctcggaacaggaacaccaatttactcatcccctggatgctgactaatcagaggaacgtcagcattttccggcccaggctaagagaagtagataagttagaatccaaattgatttatcatccccttgacgaattcgcgttggaaaaacacctctcacttgccgctcttcacacccattaatttaattcggcctctgtgttgagccccttgttgaagtgtttccctccatcgcgacgtggttggagatctaagtcaaccgactccgacgaaactaccatcatgcctccccgattatgtgatgttttctgccctgctgggtggagcaccctcgggttgagaaaaccttcttcctttttccttggactccggtcccccggtctaagccgctcggaatatgacagggttattttcacctcttcttttctactccacagtgttctatactgtggaagggtatgtgttgccccttccttcttggagaacgtgcgcggcggtcttccgtctctcgacaagcgcgcgtgcaacatacagagtaacgcgaagaaagcagttctcggtctagctctagtgcccacaagaaaacagctgtagcgaccacacaaaggcagcggaacccctctcctggtaacaggagcctctgcggccaaaagccacgtggataagatccacctttgtgtgcggtgcaaccccagcaccctggtttcttggtgacactctagtgaacccctgaatggcaatctcaagcgcctctgtagggaagccaagaatgtccaggaggtaccccttcctctcggaagggatctgacctggagacacatcacacgtgctttacacctgtgcttgtgtttaaaaattgttacagcttccccgaaccaagtggtcttggttttcactttttatcacactgtcaat

SEQ ID NO: 1463 - DNA, 1000 bp, Aimelvirus 6
  strain gpai006, complete genome.1
cactacgttacggttcccgcccgggacaactggtaccccattaggctacaacatggctgaaaagggtattgggtccccccggattgtgtccgttcgtagtgtgtgtaacgtggtttaccatctccactaacattggactaagcatttcatctttcctccccgattgtgtactcacttggctaacgctgggtggtcgcggttgggtccttgatttactttttctcgtctaagcattccgactgtcctccccgattatgtgctcattcagttaactgctgggtggtcatgactaacatcgaggaaccttctgtccacgcttactttgagctccggtcgcttgacgcttgtagggcgatagggttatcttcctgacaacatctttattctacctccataggctctatctatggagacggagtgtggcacccgtcccttctttgggagcttcggtagtgacgccctttgtcactctcgccagccgaggcatgcctggtgccaggtagcaaagaaagcatatgtttaaggacttgactgatttagcgcaagagtttgtagcgatgtccatagtgtctgcggattccccacacggcgacgtgtgccgcggaggccaaaagccacggtgttcacagcacccctatggatgcccacagaccccagtgggcactcttgttgccggactttcaggaaattaggcataggctcttctcaaactcctggcattggactaggtaagaatgccccggaggtaccccagtactccttcgggagtctgggatctgaccgggggccccacaaacatgctttacgtgtttcgtgcggtcaaaaattgtctaactagtcccaaccttgaacaagggattgttctttcctttttattactgagactggcctatggtgacaacagagattgactgtgaatacagttattttctggtgtttatcatttggtttttctccgtgctcttttacctttgtggtatttgttctttagataggcaaa

SEQ ID NO: 1464 - DNA, 1000 bp, Unknown
  Description of Unknown: Theiler's encephalomyelitis virus isolate Vie415HTR, complete1 sequence
catcccccggtcaccccctttcgacgcgggtactgcgatagtgccaccccagtctttcctactcccgattcccgacccctacccaggttcctcggaacaggaacaccaaattactcatcccctggatgctgactaatcagaggaacgtcagcgttttccggcccaggttaagagaagtagataagttagattctaaattgacctaccatccccttgacgaattcacactggagacgcacctctcacttgccgctcttcacacccatcaatctaattcggcccctgtgttgagccccttgttgaagtgccttcccccattgtgacgtggttggagatctaagtcaaccgactccgacgaaactaccatcatgcctccccgattatgtgatgctttctgccctgctgggtggagcatcctcgggttgagaaaatcttcttcctttttccttggaccccggtcccccggtctaagccgcttggaataagacagggttagcttcatctcctccttcttccacttcaagtgcctatactatgaaagggtatgtgttgccccttccttcttggagaacacacgcggcggcctttccgtctctcgacaagcgcgtgtgcgacatgcagagaaacgtgaagaaagcagtttgcggactagctccagtgcccacaagaaaacagctgtagcgaccacacaaaggctgcggaaccccctcctggtaacaggagcctctgcggccaaaagccacgtggataagatccacctttgtgtgcggtacaaccccagtaccctggtttcttggtgcactctagcgaaaacgcaaatggcaatctgaagcgcctctgtaggaaagcaaagaatgtccaggaggtaccccttccttttggggagggatctgacctggagacacatcacacgtgctttacacttgtgcttgtgtttaaaaactgtccagctttcccaaaccaagtggtcttggttttcattttttaaacaaatttcact

SEQ ID NO: 1465 - DNA, 1000 bp, Rat theilovirus 1
  strain RTV-1, complete genome.1
cgcggtgaagatcaccccgggaaaccccctttggacgcgggacctgcgacagtgccatcccccgtctctcctattccaactacccgaccctaacccagggtccaggacactggatcaatacaagtcatcccctgaatgctggctaatcagaggaaagtcagcattttccggcccaggctaagagaaacacaataagttagaatctaaattaatcaccttgacgaattcgcaaagataagtcctccctcccttgccgctcgatcacacccagaactaacaattcggcctctcgtgacgagccccttggtgaaaggacctctttcaacgcgacgtggttggagattaaaaccgactccgacgaaagtgctatcatgcctccccgattatgtgatgttttctgccctgctgggcggagcattctcgggttgatataccttgaatccttcatccttggacctcccggtcccccggtctaagccacttggaatatgacagggttattttccaaaattcttatttccactttcatgagttcttttcatgaaaagggtatgtgctgccccttccttcttggagaatccgcgtggcggtctttccgtctctcgaaaaacgtggatgcagcatgctggaaacggtgaagaaagtagttctctgtggaaacttagaacagacatcgaaacagctgtagcgacctcacagtagcagcggaaccccctcctggcgacaggagcctctgcggccaaaagccccgtggataagatccactgctgtgagcggtgcaaccccagcaccctggttcgatggttgttctctgtggaatcagagaatggctttcctaagccctccagtagagaagccaagaatgtcctgaaggtaccccgcgtgcgggatctgatcaggagaccaattgccagtgctatacactggtactttggtttaaaaattgtcacagcttctccaaaccaagtggtcttggttttctatctttaataattggttc

SEQ ID NO: 1466 - DNA, 1000 bp, Saffold virus
  gene for polyprotein, complete genome,strain:1
gcgtcttcgcggtgaagaacaccccaggggtaccccctttgaacgcgggacctgcgaaagtgccaacccaagtcttttcctgttcttaccctactccctccttgggtccattggaaggaccaactatattatcccttggatgctggctaatcagaggaaagtcagcattttccggcccaggctaagagaaacatataagttagatatgattttaatcccttgacgaattcaaaacttgatgttctccctcccttgccgcttgatcacacccacctcttaaattcggccttttgtgacaagccccttggtgaaaggacctctcttgtttcgacgtggttggaattaacatcaattccgacgaaagtgctatcatgcctccccgattatgtgatgttttctgccctgctgggcggagcaccctcgggttgagataccttgactcttttcttttggaaccttggttcccccggtctaagccgcttggaatacgacagggttattttctatactcttatttctacttttacgggttctatccgtaaaaagggtatgtgttgccccttccatcttcggagaatccacacggcggtctttccgtctctcaaaaagtgtggatgcaacatgccggaaacggtgaagaaagcagttttctgtggaaatttagaatggacatcgaaacagctgtagcgacctcacagtagcagcggactcccctcttggtaacaagagcctctgcggccaaaagccccgtggataagatccactgctgtgagcggtgcaaccccagcaccctggttcgatggctactctctatggaaccagagaatggttttctcaagccctccggtagagaagccaagaatgtcctgaaggtaccccgcgtgcgggatctgatcaggagaccgaatggtaatgctttacattatcactttggtttaaaaattgtcacagcttctccaaaccaagtggtcttggttttcctttttatccacatggcaag

SEQ ID NO: 1467 - DNA, 1000 bp, Saffold virus
  gene for polyprotein, partial cds,isolate: Pak-2457.1
tagcatcttcgcggcaaagaacaccccaggggtaccccctttgaacgcgggtcctgcgaaagtgccaacccatgtctttcccactctttccccgactcccacctcgggtctaatgaaaagaccaaatatttcatcccttgaatgctggctaatcagaggaaagtcagcattttccggcccaggctaagagaaacatataagttagatttgatttaatcccttgacgaattcgaaacgagacgttttccctcccttgccgcttgttcacacccacttatttaattcggccttttgtgacaagcccctcggtgaaagaacctctctcttttcgacgtggttggaattaccatcatctccgacgaaagtgctatcatgcctccccgattatgtgatgttttctgccctgctgggcggagcattctcgggttgagaaaccttgaatcttttcctttggaaccttggttcccccggtctaagccgcttggaatatgacagggttattttcttaatcttatttctacttttacgggctctatccgtaaaaagggtacgtgctgccccttccttctctggagaatctacacggcggtctttccgtctcttaacaagtgtggatgcagcatgccggaaacggtgaagaaaacagttttctgtggaagtttagagtgcacatcgaaacagctgtagcgacctcacagtagcagcggactcccctcttggcgacaagagcctctgcggccaaaagccccgtggataagatccactgctgtgagcggtgcaaccccagcaccctgattcgatggtcattctctacggaaccagaaaatggttttctcaagccctccggtagagaagccaagaatgtcctgaaggtaccccgcgtgcgggatctgatcaggagaccaattgacggtgctttacactgtcactttggtttaaaaattgtcacagcttctccaaaccaagtggtcttggttttccaattttgttgagtggcaat

SEQ ID NO: 1468 - DNA, 1000 bp, Aimelvirus 2
  strain gpai002, complete genome.1
taggatgacatgttccaagtcagatgccaacgacttggtaaggacgaatttgcccgcactacactacggttcccgcccgggacaactggtaccccattatgccacaacatggctgaaaagggtactgggtccccccggattgtgtccgtttgtagtgtgtgtaacgtggtttaccatctccactaacattggactaagcatttcatctttcctccccgattgtgtactcacttggctaacgctgggtggtcgcggttgggtccttgatttactttttctcgtctaagcatgccgactgtcctccccgattatgtgctcattcagttaactgctgggtggtcatgactaatatcgaggaaccttctgtctacgcttactttgagctccggtcgcttgacgcttgtagggcgatagggttatcttcccaacaacatctttattctacctccataggctctatctatggagacggagtgtggcacccgtcccttctttgggagcttcggtagtgacgccctttgtcactctcgccagccgaggcatgcctggtgccaggtagcaaagaaagcatatacttaaggacttgactgatttagcgcaagagtttgtagcgatgtccatagtgtctgcggattccccacacggcgacgtgtgccgcggaggccaaaagccacggtgttcacagcacccctatggatgcccacagaccccagtgggcactcttgttgccggactttcaggaaattaggtataggctcttctcaaactcctggcattggactaggtaagaatgccccggaggtaccccagtactccttcgggagtctgggatctgaccgggggccccacaaacatgctttacgtgtttcgtgcggtcaaaaattgtctaactagtcccaaccttgaacaagggattgttctttcctttttattactgagactggcctatggtgacaacagagattgactgtgaatacagttattttctggtgttcatcat

SEQ ID NO: 1469 - DNA, 1000 bp, Cardiovirus B
  strain Longquan-Aa3-1 polyprotein gene, complete cds.1
cccccggttaccccttctgaacgcgggtcctgcgatagtgccaaccccagcttatccctaatcccgactccccgaccctaacccagggtcctcggaagaggatcaccaacttcatccccagaatgttgactaatcagaggaaagttagcattttccggcccagacttagagaagtagataagttagagccaaattgatacaagcatccccttgacgaattcgccatgaaacgtcgtccctcacttgccgcttgatcacacccagaactaacaattcggcccctcgtgacaagccccttgttgacacgacctctttctacgcgacgtggttggagattttgaaatcctttgactccgacgaaactaccatcatgtctccccgattatgtgatgctatccgccctgctgggtggagcattctcgggttgagttaacctattcctttactccttggactccggtcccccggtctaagccgcttggaataagacagggttatcttcctaactctctctcttctactcttaagtgtcctctacttaagaagggtatgtgctgccccttccttcttggagaactcgcgtggcggtctttccgtctctcgaagagcgtgagtgcagcatgcaaagacctgcgaagaaagcagtttcctgactaaccttagtttggacaagattccggctgtagcgacctcatagaagcagtggacacccctctcggtaacgagagcccctgcggccaaaagccacgtggatgagatccacttctatgagcggtgcaaccccagcaccccggtatcttggtcatactctggtgaacctggagatggcgatcttaagcaactttgtagagaagccaagaatgtccagaaggtaccccggctcacgggatctgatctggagaccagtacactgtgctttacacattgtctctggtttaaaaactgtcacagcttctccaaaccaagtggtcttggttttcccactttactacttggcaag

SEQ ID NO: 1470 - DNA, 1000 bp, Saffold virus
  gene for polyprotein, partial cds,isolate: Pak-2491.1
tgtcttcgcggtgtagaacaccccaggggtaccccctttgaacgcgggtcctgcgaaagtgccaacccacgtctcttccttcctttaatccgattcccacctcgggtccataaaaaggaccaaatatgtcatcccttgaatgctggctaatcagaggaaagtcagcattttccggcccaggctaagagaaacatataagttagatttgatcacaatcccttgacgaattcagaacgagaagttctccctcccttgccgcttgttcactcccttccattcaattcggcctctcgtgacaagccccttggtgaaagaacctctctctttctgacgtggttggaattaacatcatttccgacgaaagtgctatcatgcctccccgattatgtgatgttttctgccctgctgggcggagcattctcgggttgagaaaccttgaatcttttcttttggaaccttggttcccccggtctaagccgcttggaatatgacagggttattttcttcactcttacttctacttttatgggctctatccataaaaagggtatgtgctgccccttccttcttcggagaattcacacggcggtctttccgtctctcgacaagtgtggatgcagcatgccggaaacggtgaagaaaacagttttctgcggaagtttagaatacgcatcgaaacagctgtagcgacctcacagtagcagcggactcccctcttggcgacaagagcctctgcggccaaaagccccgtggataagatccactgctgtgagcggtgcaaccccagcaccctgattcgatgattattctctacggaaccagaaaatggttttctcaagccttccggtagagaagccaagaatgtcctgaaggtaccccgcgtgcgggatctgatcaggagaccaactggcagtgctttacactgttaccttggtttaaaaactgtcacagcttctccaaaccaagtggtcttggttttcccattttaattgatggcaat

SEQ ID NO: 1471 - DNA, 1000 bp, Saffold virus
  strain Can112051-06 adapted, complete genome.1
gttcgcggtgaagaacaccccaggggtaccccctttggacgcgggacctgcgacagtgccaacccacgtctcttcccactattattattccggttcccgccttaggtccattgaaaagaccaaatatgtcatcccttggatgctggctaatcagaggaaagtcagcattttccggcccaggctaagagaaacatataagttagaaatgattctaatcccttgacgaattcggaacgagaagttctccctcccttgctgcttgttcacacccatcatttaattcggccctttgtgacaagccccttggtgaaaggacctctctctttccgacgtggttggaattaacatcttttccgacgaaagtgctatcatgcctccccgattgtgtgatgttttctgccctgctgggcggagcgtcctcgggttgagaaacctttaatcttttcctttggagccttggctcccccggtctaagccgcttggaatatgacagggttattttccaaactctttatttctactttcatgggttctatccatgaaaagggtatgtgttgccccttccttctttggagaatctgcgcggcggtctttccgtctctcaacaagcgtggatgcaacatgccggaaacggtgaagaaaacagttttctgtggaaatttagagtggacatcgaaacagctgtagcgacctcacagtagcagcggattcctctcttggcgacaagagcctctgcggccaaaagccccgtggataagatccactgctgtgagcggtgcaaccccagcaccctggttcgatggccattctctatggaaccagagaatggttttctcaagccctccggtagagaagccaagaatgtcctgaaggtaccccgcgcgcgggatctgatcaggagaccaattggcagtgctttacgctgccactttggtttaaaaactgtcacagcttctccaaaccaagtggtcttggttttctaattttgttgactggcaat

SEQ ID NO: 1472 - DNA, 1000 bp, Saffold virus
  strain BCH1031, complete genome.1
ttttcgcggcaaagaacacctcaggggtaccccctttgaacgcgggacctgcgatagtgccaacccacgtcttttcccactcctaacccggttcccaccttatgtccattgaaaggaccagatatatcatcccttgaatgctggctaatcagaggaaagtcagcattttccggcccaggctaagagaaacatataagttagaaatgattctaatcccttgacgaaaccagaacgagacgttctccctcccttgccgcttgttcacacccatttgattgattcggccttttgtgacaagccccttggtgaaaggacctctctctttctggcgtggttggaattaacatcctttccgacgaaagtgctatcatgcctccccgattatgtgatgctttctgccctgctgggcggagcattctcgggttgagaaatctcaaaccttttctttttggaactttggttcccccggtctaagccgcttggaatacgacagggttattttctatactcttatttctacttttacgggctctatccgtaaaaagggtaagtgttgccccttccatcttcggagaatccacacgacggtctttccgtctctcgaaaagtgtggatgcaacatgccggaaacggtgaagaaagcagttttctgtggaaatttagaatggacatcgaaacagctgtagcgacctcacagtagcagcggactcccctcttggcaacaagagcctctgcggccaaaagccccgtggataagatccactgctgtgagcggtgcaaccccagcaccctggttcgatggctattctctatggaaccagagaatggttttctcaagccctccggtagagaagccaagaatgtcctgaaggtaccccgcgtgcgggatctgatcaggagaccgaatggtaatgctttacattatcactttggtttaaaaattgtcacagcttctccaaaccaagtggtcttggttttccttttttatccacatggcaag

SEQ ID NO: 1473 - DNA, 1000 bp, Saffold virus
  gene for viral polyprotein,strain Nijmegen2008.1
gcatcttcgcggtgtagaacaccccaggggtaccccctttgaacgcgggacctgcgatagtgccaacccacgtcttttcccacttttgccccgattcccacctcgggtccaatgaaaggaccacatgtttcatcccttgagtgctggctaatcagaggaaagtcagcattttccggcccaggctaagagaaacatataagttagatttgattcaaatcccttgacgaattcggaacgagacgttctccctcccttgccacttgttcacacccacacttttgattcggccttttgtgacaagtcccttggtgaaagaacctctctctttccgacgtggttggaattaacatcatttccgacgaaagtgctatcatgcctccccgattgtgtgatgttttctgccctgctgggcggagcattctcgggttgagaaaccttgaatcttttcctttggaaccctggttcccccggtctaagccgcttggaatacgacagggttattttccttattcttacttctacttttatgggttctatccataaaaagggtatgtgctgccccttccttctttggagaattcgcacggcggtctttccgtctctcgacaagtgtgaatgcagcatgccggaaacggtgaagaaaacagttttctgtggaagtttagagtgcacatcgaaacagctgtagcgacctcacagtagcagcggaaccccctcttggcgacaagaacctctgcggccaaaagccccgtggataagatccactgctgtgagcggtgcaaccccagcaccctgattcgatggtcattctctacggaaccagaaaatggttttctcaagccctccggtagagaagccaagaatgtcctgaaggtaccccgtgcgcgggatctgatcagagaccaattgacagtgctgtacgctgtcactttggtttaaaaactgtcacagcttctccaaccaagtggtcttggttttccaatttttattgaatggcagt

SEQ ID NO: 1474 - DNA, 1000 bp, Sikhote-Alin virus
  strain P-113 polyprotein gene, complete cds.1
cccggccaccccctttcgacgcgggtactgcgatagtgccaccccagtctttcctactcccgactcccgactctaacccaggttccttggaacaggaacaccaatatactcatcccctggatgctgactaatcagaggaacgtcagcattttccggcccaggctaagagaagtagataagttagattccaaattgatttatcatccccttgacgaattcgcgttggaaatgcacctctcacttgccgctcttcacacccattaacttgattcggcctctgtgttgagccccttgttgaagtgcttccctccatcgtgacgtggttggagatctaagtcaaccgactccgacgaaactaccatcatgcctccccgattatgtgatgctttctgccctgctgggtggagcatcctcgggttgagaaaaccttcttcctttttccttggaccccggtcccccggtctaagccgcttggaataagacagggttatcttcacctcttccttcttctacttcatagtgttctatactatgaaagggtatgtgtcgccccttccttctttggagaacacgcgcggcggtctttccgtctctcgaaaagcgcgtgtgcgacatgcagagaaccgtgaagaaagcagtttgcggactagctttagtgcccacaagaaaacagctgtagcgaccacacaaaggcagcggaccccccctcctggcaacaggagcctctgcggccaaaagccacgtggataagatccacctttgtgtgcggcacaaccccagtgccctggtttcttggtgacacttcagtgaaaacgcaaatggcgatctgaagcgcctctgtaggaaagccaagaatgtccaggaggtaccccttccctcgggaagggatctgacctggagacacatcacatgtgctttacacctgtgcttgtgtttaaaaattgtcacagctttcccaaaccaagtggtcttggttttcactctttaaactgatttcact

SEQ ID NO: 1475 - DNA, 1000 bp, Unknown
  Description of Unknown: Theiler's encephalomyelitis virus, isolate1 sequence
cccccggttaccccctttcgacgcgggtactgcgatagtgccaccccagtctttcctactcccgactcccgaccctaacccaggttcctcggaacaggaacacaaatttactcatcccctggatgctgactaatcagaggaacgtcagcattttccggcccaggcttagagaagtagataagttagaatctaaattgatatgacttccccttgacgaattcacgttggaaatgcacccctcacttgccgctcttcacacccactaattgattcggcctactgtgttgagccccttgttgaagtgcttccctccctcgtgacgtggttggagaaatcttgtcacccgactccgacgaaactaccatcatgcctccccgattatgtgatgctttctgccctgctgggtggagtatcctcgggttgagaaatccttcttccttttaccttggaccttggtcccccggtctaagccgcttggaataagacagggttattttcacctcttcttcttctacttcatggtgctctataccatgaaagggtatgtgtcgccccttccttcttggagaactcacgcggcggtcttccgtctctcaaaaagcgcgagtgcgacatgcagagtaacgcgaagaaagcagttcctggcctagctctagtgcccacaagaaaacggctgtagcgaccacacaaaggcagcggaactcccctcctggtaacaggagcctctgcggccaaaagccacgtggattagatccacctttgtgtgcggtgcaaccccagcaccccggtttcttgttgacactctagtgaatccttgaatggcaatctcaagcgcctctgtaggaaagccaagaatgtccaggaggtaccccttcctcgcggaagggatctgacctggagacacatcacacgtgctttacacttgtgcttgtgtttaaaaattgtcacagctttcccaaaccaagtggtcttggttttccttttttatcctactgtcaat

SEQ ID NO: 1476 - DNA, 1000 bp, Human cosavirus A
  clone V8B polyprotein gene, complete cds.1
ggctcactcctgtacaccgtgagtccgcgcagtgctgacttaacacttaagtaatgtgtaggccgagaacgacaccgctcggctcccacctttcaccaccgtgggattaacaggttcaatacacaaattcctgtccttggctatgtcaaagcaatacagtgtgtacatgatgtgcacgctcaaggcggagacttaggcctcacagattgtgttttgtgatattgaatgctggatggtcacgttggagactgcatgtggcagtcttgaaacgtgtggtttgacgtctatccattatggcagtgggtggagtactgcaaagatgtcaccgtgctttacacggtttttgaaccccacaccggctgtttggcgcttgcaggacagcaggtttattttcttatgttctctatttctagccaacaggacactatcctgttgggcggagtgatactcccgttccttcttggacagattgcctccacgacctttgtggatctcaaggtagtcaagtcactggtgaatagagcgaaggttgaggagacctgaggaatttccatgtggctttgccaggagttgtagcgatgctgtgtgtgtgtgcggatttcccctcatggcaacatgagcctcacaggccaaaagccctgtccgaaaggacccacacagtggagcgaccccagctccctcctacaaagctttgtgagaatgaactcacgtttattcttctttattctctatttacatcaggccccaaagatgtcctgaaggtaccttgtgtatctgggcatgagcaccatcaactacccggacttgcacttcggtgcagacgcatgtggtgtcccagcccctctgcttcggcaggggggcttttgctcgctcagcacgagatctgatcaggagtctcccccggtgtgctttacacccggcgggggattaaaaattgcccaaggcctggcaaaataacctaggggactaggttttccttttattaacaatgtctgtcatt

SEQ ID NO: 1477 - DNA, 1000 bp, Human cosavirus A
  strain AM326/BRA-AM/2017, complete genome.1
tccgctgtgatgggctcactcctgtacaccgtgagtccgcgcagtgctgacttaacacttaagtaatgcataggccgagaattacaccgctcggctcccacctttttccatcgtgggattaacaggtttaatgcacaaattcctgtccttggctatgtcaaagcaatacagtgtgtactcggtgtacacgctcaaggcggagatttaggcctcacagattgtgttttgtgttgttgaatgctggatggtcacgttggagactgcatgtggcagtcttgaaacgtgtggtttgacgtctatccattacggcagtgggtggagtactgcaaagatgtcaccgtgctttacacggtttttgaaccccacaccggctgtttggcgcttgcaggacagcaggtttattttcttatattctctatttctagccaacagggtactatcttgttgggcggagtgatactcccgttccttcttggacagattgcctccacgttctttgtggatcttgaggtgatcaagtcactggtaagtagagcgaaggttgaggagacctgaggaatttccatgtggctttgccaggagttgtagcgatgctgtgtgtgtgtgcggatctcccctcatggtaacatgagcctcacaggccaaaagccctgtccgaaaggacccacacagtggagcaatcccagctccctcctacaaagctttgtgagaatgaactcacgtttattcttctttattctctacttacatcaggccccaaagatgtcctgaaggtaccttgtgtatctgggcacgagcaccatcaactacccggacttgtgcttcggcgcagacgcatgtggtgactcagcccctctgcttcggcagaggggctttttgctcgctcagcacgagatctgatcaggagcccctcccagtgtgctttacacctggcgaggggttaaaaattgcccaaggcctggcaaaacaacctaggggactaggttttcctttattaaca

SEQ ID NO: 1478 - DNA, 1000 bp, Picornaviridae sp.
  isolate bbr144pit2 genomic sequence.1
tcagaacagaatactcagtggacaggggaccaatccaatataagtcttgaccgggcctttctggaccagatgtccttaaggaggctgtgccaagccaccaggtaaatctctcaaagagagtccagagtctcgtaggctatgctgtattaatacagcaaagacccacacatccccgctttcaacgtctggcccacgaaacgggccactttctcggtctgaccattggtttattattgaaattggcttggaaatgctgacactgtaagttggtttgtgatttaaacaatggttaatctggactctctttgagagatttacctggtggcttggcacagcctccttaaggacatctggtccagaaaggcccggtcaagacttatattggattggtcccctgtccactgagtattctgttctgaaccgtgtaggcagggctagcgccaccatgattgccaagggactacctccctggtgacagggacccttgggcccaaaaggctaggtggcaactctcatgtcaagagaggggtatccaccccaatctgaatcatgtggagtgaagccactcgtcatggctctgaccccgagactgtctacatctagtaagatggatgaaaactggatttggagaccactctgattgtcttgatgagaaagtccgctatttgactgagtagatgccctccagctacccttatggatgtgaggaggggaccgtgactatagcgttccgctaaaccggtttaaaaaacatgaaaggtcaaatatgtggcgccattttccacttatatcaataaccatatgtctgacgaagttgattgtgctgagtgttctaagccctcctggactgtcagattaaaattggcttttctgcaatattttggttgccagtttgtatgggtttatcactcaggaaagaatcaagagaaagattgaaaatcttggattgtgcaacaaaagctcatttttgtccttgtgaaggcaaccagagattgcagtc

SEQ ID NO: 1479 - DNA, 1000 bp, Cosavirus F
  strain NGR_2017_NHP_CV, complete genome.1
cggtgtgatgggctcactcctgtacatcgtgagtatgctcaaccactgactaaagggctgcttgaacttaacatcatggattccgatccgttacattgatcggcccgtgcccttctcaatatgggattaacagagcttcaacttggttttcctgtcttttagcgttccaacggtattatgccacaacatggcagaaagcccgcggtagctatcacagattgtgtaaccaggtttggctgctggatggtcatattcagatcgcatgcatgtgtggtcttgagatatgtcccggttgacgtttcccttatgttacattcttgacagccggtggagtgctgaaattacgtcaccatgctttacatggtttttgaactccacgccggtcgctagacgcttgtaaggcgataggcttatcttcctatttctcttctttctagcccagtaggttctatctactggggcggagcgaggttcccgttccttcttggacagctggtcaccacaccttgtggattcttagactggcaaaacactggtgcaagagttgaagggattatgtgtttaagtgaagttctactgctttttgaggaatcgtagcggtgctgtgtgtgtgtgcggattccctcctgcggcgacgcaggcctcacaggccaaaagccacggtcgaaagaccccacacagtggagatatcccatctccttcctctcttagtagtttaatgaatctttttcacaggatcttataagactactgcatttcagaccccaaagatggcctgaaggtaccttgtgtattcactttggctgaaccaccgactccccggactggctttgccgacgcatgtgggtgcccagcccctgcccttaagggcaggggcttccctcagcaagtgacacgagatctgatcaggtgccaggtcactggtgctttacaccaccctggttaaaaattgcccaaggtctgacaccccaacccaggggactgggttttcttttatctt

SEQ ID NO: 1480 - DNA, 1000 bp, Human cosavirus
  isolate HCoSV/CMRHP57/CMR/2014 polyprotein gene,1
ctcactcctgtacaccgtgagtccgcgcagtgctgacttaacacttaagtaatgtttaggccgagaattacaccgctcggctcccacctttcaccatcgtgggattaacaggtaaactatgtgtattcctgtccttggttgtttcaaagcaatacggcatgtgcaatggcgcacaggcccaaggcggagaattagacctcacagattgtgttacacatttgtttatgctggatggtcacgttggagactgcatgtggcagtcttgaaacgtgtggtttgacgtctaaccattatggcagtgggtggagtactgcaaagatgtcaccgtgctttacacggtttttgaaccccacaccggctgtttggcgcttgcaggacagtaggtttattttcatttgaattctcttttctagccgtgtaggatctatctacacgggcggagtgatactcccgctccttcttggacaggtgacctccacgctctttgtggatctcaaggtgaccaagtcactggtgtttgaagtgaagattgaagagacactagggagtttcatgtggctttgccagggattgtagcgatgctgtgtgtgtgtgcggatctcccctcgtggcgacacgagcctcacaggccaaaagccctgtccgaaaggacccacacagtggggttgccccgacccctccctacaaagctttgtgcaaacaaacttttgttttgtctttcttaagcttctctcacatcaggccccaaagatgtcctgaaggtaccccgtgtatctgaggatgagcaccatcagctacccggacttgtagaacacattctacagacgcatgtggtaacccagcccctctccttcgggaggggggctttgctcactcagcacaggatctgatcaggagatccacctctcgtgctttacacgagggcgtgggtttaaaaattgcccaaggcctggcaaacaacctaggggactaggttttcctttattcaaaagttgtcaat

SEQ ID NO: 1481 - DNA, 1000 bp, Human cosavirus
  isolate HCoSV/CMRHP49/CMR2014 polyprotein gene,1
ctctgccagtgattcccccttgcgggatctttttaaactttatttcaaactacgtttctaagcaactttaaatacacaagaacgttgacccttccattgggaatggaagagatgaaattgaaatggaagtattctattgtaatgtcaatagtcttaccatccgctgtgatgggctcactcctgtacaccgtgagtccgcgcagtgctgacttaacacttaagtaatgattaggccgagaattacaccgctcggctcccacctttcaccatcgtgggattaacaggtaatttgtatacattcctgtccttggttatgtcaaagcaatacggcatgtgcaaaggcgcacaggcccaaggcggagacttagacctcacagattgtgttgtatattaaattatgctggatggtcacgttggagactgcatgtggcagtcttgaaacgtgtggtttgacgtctaaccattatggcagtgggtggagtactgcaaagatgtcaccgtgctttacacggtttttgaaccccacaccggctgtttggcgcttgcaggacagtaggtttattttctttcaacttctcttttctagccgcacatgttctatgtgtgcgggcggagtgatactcccgctccttcttggacaggtgacctccacgccctttgtggatcttaaggttgccaagtcactggtgtttgaagtgaagattgaagaaacactagggagtttcatgtggctttgccagggattgtagcgatgctgtgtgtgtgtgcggatttcccctcgtggcgacacgagcctcacaggccaaaagccccgtccgaaaggacccacacagtggggttaccccaacccctccctacaaagttttgtgcaaacaagcttttgtttagtctctcttaagcttctttcacatcaggccccaaagatgtcctgaaggtaccccgtgtatctgaggatgagcaccatcgactacccgaacttgcgagcaaatttcgcagacgc

SEQ ID NO: 1482 - DNA, 1000 bp, Human cosavirus
  E/D clone V13C2 polyprotein gene, partial cds.1
ctcactcctgtacaccgtgagtccgcgcagtgctgacttaacacttaaataatgtttaggccgagaattacaccgctcggctcccacctttcaccatcgtgggattaacaggtgactagtttgtattcctgtccttggttttatcaaagcaatacggcatgtgtaacggcgcacaggcccaaggcggagatttagacctcacagattgtgttacaaatttagtcatgctggatggtcacgttggagactgcatgtggcagtcttgaaacgtgtggtttgacgtctaaccattatggcagtgggtggagtactgcaaagatgtcaccgtgctatacacggtttttgaaccccacaccggctgtttggcgcttgcaggacagtaggtttattttcttttaaatctcttttctagccgtgcaggatctgtctgcacgggcggagtgatactcccgctccttcttggacaggtgacctccacgttctttgtggacctcaaggttaccaagtcactggtgtttgaagtgaagactagagagacactagggagtttcatgtggctttgccagggattgtagcgatgctgtgtgtgtgtgcggatttcccctcgtggcaacacgagcctcacaggccaaaagccctgtccgaaaggacccacacagtggggtgaccccgacccctccctacaaagctttgtgcaaacaatcttttgtttagcttttcttaagcttctttcacatcaggccccaaagatgtcctgaaggtaccccgtgtatctgaggatgagcaccaccgactacccggacttgcgcacctaacgcagacacatgtggtaatccagccccctccttgaggggagggggctttgctcactcagcacaggatctgatcaggagatccatctctggtgctttacaccggagcatggatttaaaaattgcccaaggcctggcacacaacctaggggactaggttttcttttttatttttcaagtttgtcaat

SEQ ID NO: 1483 - DNA, 1000 bp, Coxsackievirus
  A10,isolate QD102R/Shandong/China/2014, complete1
catgtcttgatcaagcacttctgtaaccccggactgagtatcaatagactgctcacgtggtcgaaagagaaaacgttcgttatccggctaactacttcgagaaacctagtagcaccactgaagctgcggagtgtttcgctcagcacttcccccgtgtagatcaggtcgatgagtcactgcttaccccacgggtgaccgtggcagtggctgcgttggcggcctgcctatggggcaacccataggacgctctaaagtggacatggtgtgaagagtctattgagctagttagtagtcctccggcccctgaatgcggctaatcctaactgcggagcgcatgcccccaaaccagagggtggtgcgtcgtaacgggtaactctgcagcggaaccgactactttgggtgtccgtgtttcttttattctcataatggctgcttatggtgacaattgaggaattgttaccatatagctattggattggccatccggtgtgcaacagagctattatctacttgtttgttggatacattccattgacacctaaatccttcaatacattgtactatattttaacgttgaacgcaagaaaatgggagctcaagtctcgacgcaaaaatccggcagtcatgagactggtaatgtagccactggaggatctacaataaacttcactaacatcaactattataaagattcttacgccgcgtcagctacccggcaagacttcacacaagatccgaagaaattcacacaaccagtgttagactctattagagaactatcagccctttgaactctccttctgtggaagcttgtggttatagtgatagggtcgcccagctcactgttgggaactcctccatcactacccaagaggctgcaaatattgtattagcttatggagagtggcctgagtactgccctgacacagacgcaactgccgtggataaaccaactcgtccggacgtgtctgtcaacaggttctacactctggactccaaa

SEQ ID NO: 1484 - DNA, 300 bp, Hainan astro-like virus 1
  strain LPXYF118785 hypothetical protein,1
acccttggacgagacaactttccagatcattgttgtgacgctgctttttctcgcatttgttcttcaacttttttccatcgcgctctcatttgtgagccttcgagaagaacaagtgtggtctcccaaaccacgttgggatcgacgtcgtcacaaccaccatccttaaatggaaattgatgaacttgtgttaattgttttgaccctcaatacgattttatttttcttttttattgttgtcgttgttttgatttttggatttattttgtttaatttttgttttcgaaatcggtgtatacccta

SEQ ID NO: 1485 - DNA, 300 bp, Beihai sipunculid worm virus 1
  strain BHNXC40689 hypothetical2
gtcatcggctttgccttcggacaaggcattataatatgtgtccctctgtgcggtgcctccgtacatctgcggaaaaccaaaaaggcaatgtttgtattggttaccatgttcatgttttttacgtatttatatatttacataggcttgcatacatttgtaaaatagtaaccggcgtacctctttcgcacgggaggtgcgactgtacatagaagtgcgtccaacacaacaatctacgatttagagccgactctaaaaacacaaaaagtcggcaccgtcacgttcgctcatgcggaccaacct

SEQ ID NO: 1486 - DNA, 300 bp, Wenzhou channeled applesnail virus 4
  strain WZFSL85898 putative1
tagtgaaaggcagcctgacatgataataagagttgttacgtacgagagatcttctccaattggacagctttcacagcgattcagattagagaacacaatctgtttgtctgcagagcatttcttccttttgaatatagaagacggtcctgtggccttggtgacccctttcttgaacttctatgcagagcgatttgttgcattcaacacctcgccttcgagtgtactcatttccttcgaccaatccatctacgccccatataatcctcatctccaggcaagacagatccaggcagtgtcaga

SEQ ID NO: 1487 - DNA, 301 bp, Lampyris noctiluca chuvirus-like virus 1
  isolate 17FIN7 segment 2,1
atgatacattaagagtagtggataatttaactgcaaaggctagagaaggggcaaggacgaccaatgtcaactcaattggtggaagctgttagagcagcgtttttaaccctagacataagcttagatatatagtgtaggatataccgttaagataccagccttgtagagatgggattgttttaaaaccttaaaataatgaagatacaacagaattcgtatcaaagattcataccataaattgttattcaatcttttacgagtgattagtgcctgttagtattatctacatttgaatttgaaa

SEQ ID NO: 1488 - DNA, 301 bp, Hubei virga-like virus 16
  strain arthropodmix13816 hypothetical2
agctcatgtaccttttacctgtcactcttttacagttgcttcaggttttgttctctccgtcaacaactataactcagaagtgcgaagctgcagagttttaccagcgttataattttctttactatagtaggtgctcttattctgtaaaatattttatctgccccatttgtatccgaagatgttatttttgtgatttctttaatcaagtatttgactgctattggagatttttccagttttcagtttttagaaattttatctgtatagttctttttattcttattattttgtttccgtaata

SEQ ID NO: 1489 - DNA, 302 bp, Barley aphid RNA virus
  10 09BaA3 gene for polyprotein, complete1
cctgtaaacccttgttacttcagtcttttcactgttataaccgtttactactcttggtattccataaataaagaaaatttaagtttcttgatttaacccaatttctaaaactattggttggtttgaatcaaatcttgcgttgttgacacgacactcttgctattaagtttaagagtccaagatcaataccgcgaactctctatactggtgaggaaccgtatagataaccgtcaagttgttgtagacttgcgttaactattttaactttgtttaaaatactgtagtttccagtctgaagcaaa

SEQ ID NO: 1490 - DNA, 302 bp, Beihai bunya-like virus 3
  strain BWBFG40849 RNA-dependent RNA1
atagaacacacttgtgcgcgactgccccccgaagggggcccataacatggaaaacaaaagcaaaagtaataacacaaataaaaacaatactaagctacctcatccagatcagaagggttatagattttacgaattatcagaagaagagaaaaagaagctgattagaccaaggattcaattagaagattatagtacaaaacagagggctagagaggttgaccgagtgacgaggtctcaaattccaaaagaggaaataatattatctgataaagtaaaagaggtacttgagaagtttcctatag

SEQ ID NO: 1491 - DNA, 303 bp, Bremia lactucae associated dsRNA virus 1
  isolate DML-A_DN43224 ORF22
gaagttcgttcccgtgtgtttaaggtttcagtttatgactgggtccgagactctcctgctaatggtttaactgaagattctggtcgtcttgagtggatatatgatactaataagtgtcttatcctggctcaaggtgacggctggtacgttagacctttagtccaatctgatataattaatttactatctggtgagggcgatttagtaggagacactctatatggaggtagcacatgggaagagaaccatatcttgaaagtccctagttctgttcataaatttactccgtcttgggtttatact

SEQ ID NO: 1492 - DNA, 303 bp, Strepsipteran arli-related virus OKIAV104
  cRNA sequence.1
aaaagcgacgcaaaccgccaacagcgaaagcacaaaaagaagacaaacgaaacgagaccatcaaggagttgcgaggataataagttcgagaagtgcaaatataatttagtatttgagttaattacaaaagattaatcaaaacaatatatctaaattagaataattgatcgcacttgggataaaagatatctatatatttgaaattctagtagtttttagatttataggtagtagaataaggcaaaataatcctctttacagataagcaagagatctttctgatctagtttcacagatacaatt

SEQ ID NO: 1493 - DNA, 303 bp, Beihai picorna-like virus 79
  strain BHBJDX18844 hypothetical2
attggcatcgaccgcaatgtcattaaactacgaccggggcaggttaccacgtgcagatcgacaataatctggctaaaagtgatgcacggaggcgccccaaacgacacagttgggtatttacccttacttccaggatgctgttgtggcagccccacgaaaatccaggagaccagatcgacgccgcccagttaagctgctgtggcaactaggctttatgtttagggcgtttaaatgagttagcttgcaacaaataacatcaaacttgcaactctcgaggaagagtttacacatgacgcgactacc

SEQ ID NO: 1494 - DNA, 304 bp, Beihai picorna-like virus 124
  strain BHBJDX18598 hypothetical1
cagagattattattgtttatctctgtgcttccgtcaaatacttattgcttatacttatattttattgaatatttcgaccgagtttacgttggacccaggtgagtcgtaatacgtttactcgtcaagccattttacaagattgatccgcgcgattgggattcaagtctagtcaaacccatttatacatcttctatagcgcgtgacgctttcggtttgtggaaggatattagcgaggcatttgttttagcagtctacctatttgttggagttgttgtgagatctatagacagtgtcatttccaaga

SEQ ID NO: 1495 - DNA, 305 bp, Tacheng tick virus 8
  strain TCP-2 polyprotein gene, complete cds.1
gttacgtcccgcgtttggcttttgcccgtgctttgataaagagcatttcggacttttcggcgagttttcttcgttagtcgaaggaaatttttgacaacaaatttgttgttttatctcgacacttatcgtggtgtagagatctattaattatttgatacaaatatttgtattagataattttatatatataaatatatataatttagttgtattcttttgctttgtttaatagtagcatttaacctacgctttttcttgctttcatttgttacttgttaatcttcttgagagtttgattttttgct

SEQ ID NO: 1496 - DNA, 305 bp, Beihai picorna-like virus 6
  strain BHNXC41284 hypothetical protein2
ttggctttgactagcttaggctttcctggatgagcctttaatcatctaggtctttttgtgctttatatatttatgggttataaaacttctttttctttagccttttcctgtaaggaaggccctttatataaagtacggttctgcgtgtgagcgtgtggggaggtatttacttccgtcctttggcattacttacgttaagtcgggtatttgtcataaaattttaggaaatcgttcctggagggtctagtatgagcagctagcctcctatggtttaaatatagctttcttttaattatactaatttt

SEQ ID NO: 1497 - DNA, 305 bp, Beihai picorna-like virus 42
  strain SCJXSX39263 hypothetical2
gtgatcacatcaccattggcttgcgggaggatcgctatccgctagcttcttaagaaagcgaagactatttggtacagtagtcgattgaccattatctcttcatgtactacggtttgtcgccgtgccccaagacacgaaacagttggattaatctgtccactgtgggtgtaatttattactagtagatttctaaacaatacaatgaagagcattggggaacgcggtataattcccccgcggtttggtatcccgcgacaccagaattaccctccacttccgtgcacatcgtgccagcgcgaacggaa

SEQ ID NO: 1498 - DNA, 305 bp, Hubei toti-like virus 14
  strain QTM6211 hypothetical protein 11
tagaatacgctggaacatggtctccagatgctggcagtcatctgggtgaacctaggaaataccgactgcctatagctgccacccatcttccaatacctatcaacccgagggagtatcacattcatttaccggacaaacttttcttcgaactcaccgttccaagtagtttgaggcgccggccgaaggatgttgagaaactccggcggtattgggggaccgtaccatcatggtggcctatatctaacacgacagactgcgcatggcccatctatgtgcactacaactcaatcaaatcttgtggccat

SEQ ID NO: 1499 - DNA, 306 bp, Trichosanthes kirilowii picorna-like virus
  strain pt111-pil-52
aacttaatagttttctttagtacattcattataattctagtttttattataatttattattatatatatttttaggatttagtgtagatacagagttataatgcattttttataaaattttttaattgcagctactgaacattttttcctattttcaatttttaaaaattttcgtttaatgattgttagaattgtagtaactaacttaaacgtaaaacaaatgctacagcaaccaatcaatcaataacacaatcaaattcagttttttataataataagagcacggcagttagagactcaggctca

SEQ ID NO: 1500 - DNA, 306 bp, Solenopsis invicta virus 7
  isolate Formosa, complete genome.1
attcgcatcgacctcacgtaaaagacgtagagacttcgagatccttcgagtgacgccgaagagaaaatacgcgttattgttttaaaaagtgctcctcatattgagacgaagccgctgtcgctatcacgaccacagcataatcatcttcgtgagacccctcgccagtatctccgaggttaatcctttgattcagcgctcgcgcgtgccacccaccgcttaataagaacgttctgggtttgtcagttttgaccctcacgtggcaccacttaattgacatcaaattaaagtttcgtcatcttctaaaag

SEQ ID NO: 1501 - DNA, 307 bp, Bipolaris maydis chrysovirus 1
  strain SS01 segment RNA3, complete1
cgataaaaacagaaaatccgatagcacgacaacagatagttggccaattgtttaaaacaagattgagatcacttaataataaataatttaaatcaaaattaagttggtgtcttggctggctggtccagaacaagttgtcgagccgtctgatgagtagcacctcagggtcacgaaacgctggacgtaacggcggaacagattattgaggttagtagaacattatcacaaacaaaacaacaacaacacaatcacacaacaacgaacaaacaacaatccaagacaagcactagaggttagcacatgcaag

SEQ ID NO: 1502 - DNA, 307 bp, Human respiratory syncytial virus S2
  complete genome.2
caaatatccttgtagtataaattccatactaataacaagtagttgtagagttactatgtataatcaaaagaacacactatatttcaatcaaaacaaccaaaataaccatatatactcaccgaatcaaccattcaatgaaatccattggacctctcaagacttgattgatgcaattcaaaattttctacaacatctaggtattactgatgatatatacacaatatatatattagtgtcataacactcaatcctaatgcttaccacatcatcaaactattaactcaaacaattcaagccatgggacaaa

SEQ ID NO: 1503 - DNA, 307 bp, Sitobion miscanthi flavi-like virus 1
  07BaA1 gene for polyprotein,1
ctttcaccccttgtggaccctagtgattactgagtacttctacttagaatcctgtctcacagtttttggtgttttctaaataagcataattaagttgcttggttttgttatatttctattgttgtaacatagccttttcgcgttgtctttacgtcccacttctcattagagtaaagtgtccaaagagataccgcgtttttgttttgagcgttgagagaatccgctcataacaggcaccagtcgttgtagactagtgtatctgcacaaatttttattttatttttattttaactatttgtgtaccacc

SEQ ID NO: 1504 - DNA, 307 bp, Picornavirales Q_sR_OV_036
  putative non-structural protein2
tccccccacccacggcattggaatggggccttctttctatggaggaaagtgtgaaggcagcaaatcctgaatccaatgctaagagacgagggttatttagcccgtttatgccatggcgcgtctttaaataaaagctcggcatacctccagtcttcccttaggaataagtgtaccttaggtcgactataaaacaaccacacttgctaacaatgatacaacaaccccccaaactgcatctggttttaccacaaaggaggatttatcctctcgaggacgtcttgatactattcaagacgtttcctcctct

SEQ ID NO: 1505 - DNA, 307 bp, Hubei tombus-like virus 5
  strain WGML136364 hypothetical protein 11
cacgggtgcaccgttaagcacttcaccatgggcatggtaaggttgaatgcccccactcggaaggtggttaacaccgctgaggaccagcgacaccaattccccgctctggactgagccgctcggcgcgatcgttaagagacagcaccaggctagcgtctgccatcaacatagacgtgggaagcatatcccttggaagcgattgcatctgagaacagcccgtaaacttcagcggtaagtgggtcggtcgcctgatcgtgatggccccaggtgcgtgggttaacgcaccatctccccccactaatacact

SEQ ID NO: 1506 - DNA, 308 bp, Big Cypress virus
  strain BCNP2-24 A hypothetical protein 1,1
cataaattcattataaaaaccaagtcgtgcaatcaatttgtacgatcataccaggtacagtttcaatagctgtactcagcaatctgctataaatcaattttataacaacatcacgtgcttacggtcaattcgtaagcataataatcagttctaaataattgtttagaaccatcacgccgatacaagaactttgtatccccataacttgaacgctgtcaatcaacgctcaaaatatccacctacagacacttctgtaagtctcgcgcaatttttcaatattttgaaaaactattccccgtttacccgca

SEQ ID NO: 1507 - DNA, 308 bp, Plasmopara viticola lesion associated ourmia-like virus 11
  isolate1
gccgcaaagtcaagactttacgtcacgacatccgtaaggatgtctggccgaaagggtttccccgaattttagatctttcgatcgataggactgctgctcgaatgagtgtgccgtcttttctatcattgattagtaatttttggacccttaggcccggtattaaatattatgtgcccgcagttgtggtctgcgttacctttctccacactagggatagcatctattcagccatcgcgtacatacctgaatcaaaacaaagtgatagcgcgcctggcccccgttacgggccatcgtaaaacccctcgaac

SEQ ID NO: 1508 - DNA, 308 bp, Perth bee virus 1
  isolate WA2-13 nonstructural polyprotein and2
tcttgtaaatatatataaattcctagttctaaaatatttattatgctatttgtgtattgtcctttattatttaatattaccgcccaagatgggacgaggcagcccctcaatatctagggcacctaggtgcagattgtctgttttagtggacaacaatctaaagaaactcactagcttcaaataacaatttaaccgaaaccaaaacaaaagacacaacctatcaagctagacttgacgaacacactgaagcaggagatattaatcctgggatcgagtaccaacgacaaattgtcactttttcagaagat

SEQ ID NO: 1509 - DNA, 308 bp, Ginkgo biloba picorna-like virus
  strain pt112-pil-2-NY genomic2
aataaacaaatagacatactgtaagtggattgggttataatcgagtaattggcgcttgagccacagcccttacagtaatccacaaaagccaattagagctgatttgattgtataagcttgtaaattcaacaatcgcaaaacaattagataatattgaaaatttaatagatgaagaattgaatctatcatgcggaattaaagaagaatctcaattagatgatgtagtgacagatatatccaggtccataagaccttatctaccatgggaatgtggattaatattagctttagtaccacccttagtaggg

SEQ ID NO: 1510 - DNA, 308 bp, Changjiang tombus-like virus 8
  strain CJLX29920 hypothetical1
ccttatggctttatttgtggtggtgtgaggagaccacgttgtgacacaacaaatagcctcgttgccctggtattacgagcgtcggtaaggttagcatcttgctgccagggatcggtaggtgcatatacgtcaagtgatgtgtgtacctttaatagggggcggcataaggccgccactgtagcacgcgtagcgcggtctaacgaaccgttgttggaggggcgtgttaccaccggcttgccggatggctggtcattctccaggtgttcccctccactccatgacaggaacccctaacactactacttcca

SEQ ID NO: 1511 - DNA, 309 bp, Phomopsis longicolla hypovirus
  isolate ME711, complete genome.1
gggtgtagagaacctctgcgaggttcaatcataatggacatttgtgatgtacttacgtctctaggacgcccattactggtttatactctgtcgagttatcagtgattgtgcttgttctacgtatggaagctacagtttcattcgtaaagctcctacccctgattggttaagaacctgattacactaatgtgtaggccaacccgctggccctagcggtttcattcaattcttgttgggtgttctgtgaacttgaatcggtgagatgggcccgtgtgccccgtctggcctggactttaactagtgcctgag

SEQ ID NO: 1512 - DNA, 309 bp, Fusarium oxysporum dianthi hypovirus 2
  complete genome.1
agacgatttcggtcttacgcccactaggggcgcccaatactggtttatactctgtcgagttgtttgagctggcttgcggacattcaaaggaacgtctcgagctattgggtagcagcaaacgtgatacatgggaagcgctgttgatccgtcggggaggctgtctagcgcgtttggcttggccagctgaggtcagtagggctatgaaacccaagggtggcgatcccacccaatcagcctaggaatccacaccaggataggtgcacggcttaacaaccgaggcacgtggaaatttggccagactatgagtgt

SEQ ID NO: 1513 - DNA, 309 bp, Hubei tombus-like virus 24
  strain GCM76561 hypothetical protein 11
accaatatggttgagtccctggttctctacccatctaactgtcatggaccgttgaaggctggcaaccggaggtgacgcagatttggggtgtttcggactctgtgtattatcttaccgtccggggttttattccctgggaaccgcataattgatattgatgttagacggcagcgaggaagtgatactcagaggaaacgaatctcatcgaaccatcgaggagtccgacgagcagcaggcaggcttgcgactgggattcagcgatggaacgaaaataatggtggagcgtcggcggcagatgatctggccctc

SEQ ID NO: 1514 - DNA, 310 bp, Riboviria sp.
  isolate muf160shi4 genomic sequence.1
gaactcgtccgacacaggaaaacgcgctctaaagcgcctaaaacatacagattacataatttcagagtatgatgaggtagttctcaataagtactttgaacccaacctagtgatatcgagactcctcaaggaatcctcccacaccatagcagctgttctactcgaacaggcaaatattgcttgcaacagccttcgcggcccaaggactattgaaataggacctgatgcaagaatacaagacacacacaagtgcgccgggctaatatgggcctgtagtgacggtaaggaccaaaagcgaattatcgagcac

SEQ ID NO: 1515 - DNA, 310 bp, Sclerotium rolfsii fusarivirus 1
  strain BLH-1-10 RNA-dependent RNA1
tatttaagttattaattgagctggatcattttgtcggagatttgatggatctccctggctgtcctggccagtcttggatgtgctaagttgtgggtagtttccctaggtttcatgcctgcactctttcggaaaattccgaggtggattaaggtgcatctggctgaaaatagttttaaatcactcgtctccatcgcgttttgttcatttaaatcatgcttggtatcaagcctgatagtgccttaaagaccctgatgagccctggcacgaaacgcacttttgtgcgttggttgattttagttgttttgttagt

SEQ ID NO: 1516 - DNA, 310 bp, Auricularia heimuer fusarivirus 1
  isolate CCMJ1296, complete1
ggggtttcgttgcagccttaagtgtgtttcacttgtagactggccagtacggctggcggccctttgtggggcgccttttgtgcaatgcttcgatcccgtacaacaatctggcatttcgccgggcctggcagggcttctcggactttttaatcacgcatgctttctctggctttctcggcgcgtgttttctcggactgtggctaaaattcattaaaatccaaaaacaatgccactacctcaatctcctacttgaccctgatgagcaaggagcgaaacacgactgccatcgtgttggttatgaagttttaaa

SEQ ID NO: 1517 - DNA, 311 bp, Plasmopara viticola lesion associated bunyaarenalike virus 11
ctccacttggtggattgcgacaatcgggctgccactctcattgtagatttgaatgacaggaccccgatggttgcgaccccagtggagtcggaagtggattttggctaattgggtgttgtcgattatggcactcacgtcggcatggcgctgcatgggtgcggtactatggtttgtggacttggcagcaatattgtaatataattgtttcattacctatagtgtgtgtgctgggactggcgtaatacgtaacaactagtcccaaaaaccaaaaaactctttaacaaggattgtcctttgttttcaactgaacg

SEQ ID NO: 1518 - DNA, 311 bp, Xiamen sepia Stingray hepacivirus
  strain DHHHBHGS10983 polyprotein1
aagggaagccctcctaggggcagggagtaaaacagccacccgtcgtgcggtctgcaaaagtctgacgctttgtgtgtatcagggtaaacccaccggaaggtggtgctggttttgaccaaaggcctgaatggtaacacattgccccagacagaactcactgtaatgcgtggtaagtccgtcgtactagtgggggggctctgcctcacttaatacaacagccggaatgagcacaccgagtcaaatctgggtgtatggttccgaaccgtctaaccgtaggttccaggtaactggaggcgtcggccgttggaggc

SEQ ID NO: 1519 - DNA, 311 bp, Barns Ness breadcrumb sponge aquatic picorna-like virus 1
  isolate2
atatatatatgtataataaataaacaataaataaacaaataaaaaagaaacaacggtcttgggaagactaattaaaagcatccctctaggcgtaacctaccatgtctataataaataaccaaaaggaggctctttgtattggattaccgtgcgtgtccaactagttagtcataggacactgcataggcttgcaaagagaggcactttccccgtaaagtacccctattcaggggagtaatcgccatacagaagattaacacacgcattgtagaataagtcttctactttagcgttcataatgacttactagt

SEQ ID NO: 1520 - DNA, 311 bp, Wenzhou picorna-like virus 19
  strain WZSLuoII97616 hypothetical2
tcatattaacaagggtttttgggactaccctgcagatgcttttcctgcaattctgtcccaacgctagattgctaacgatttgccgatatcgtcgaagatctttctagcgtcgcgtgatttatattacatatatattgcccattcgtttctggggctaatgtataccggtgtagcgagccatggctgcttggttaaagtgacccgtctgtgtgtataggcataaccacagatgtattttgtctgcgaacaacaatcaaagtaatacacatggtctattgaccgaattcattgatggagcacatggcaccaca

SEQ ID NO: 1521 - DNA, 311 bp, Hubei toti-like virus 21
  strain CC64629 hypothetical protein 1 and1
actggggcaaaccaaacgttttatcccctgatgaagagtggacatatgaagattttagacaaagtatactacattacggagataaggtagcgagtggggaagaaaaagtctcatgcgaatgcgacggaagaataggatgggaaagggacctaactgaatttaaccaaaacttgaagcggttccatctaccagaagtgcacaagagatgtgcagggtgttacttgaataaaggcgcattagaagatgggctacacttactgttatacttagtgccgaaacaacagcaacacataattatagaacagtacaac

SEQ ID NO: 1522 - DNA, 311 bp, Hubei tombus-like virus 2
  strain WHSFII19265 hypothetical protein2
tgaacccacttgggattagggcggagctaccgtcaacataaagccgcagacggccctgcgataacaaacagcaattgggttgatgtacatagaggaccaaaactgtgaaccctccggggggacgcaaaatttcagtgctaaacaaaacgccaagagactgcacggctccgcgttcctctatcgttagagacaaacgtatacatcgatgtacagtccccgtttgtggttcgggggtccaagaccaaccactactttcttcaccatttccgatttaactcttaatttctacaacgccactgtcattatccgtt

SEQ ID NO: 1523 - DNA, 312 bp, Plasmopara viticola lesion associated dsRNA virus 1
  isolate2
ggaatttgttcccatgtcttcaaggttaggccatataagtgggtattagaatcgccactattggccatctcagatgaaacaagtcagctagaatgggcatatgatactgaaagtaacataactcgtgttctagctgacgggtggaacttgagacctttagctcattcagattggttgtcactttataataagactggttctttaattagtgataatgtgtcgggagcgtcgacatgggaagagaagtatccttcagaacctcctaataatttacatccatttgttccaaagtgggtgtattcattgaagctc

SEQ ID NO: 1524 - DNA, 312 bp, Linepithema humile polycipivirus 2
  putative capsid, hypothetical1
ccaaccgtttaaaaatccaacgtaaagttctttatataagaacttaacgttccggttgacggcaggatcaaacctcagtaaccaatgaacctgagttaggaactacgggagctgggcgcagctggcggcggatcaaacctggaacccccagttaggaacgaccgagagggcgaggatttttaaacggttggtgtcgttattcacccttgatggaatacaagtaaaaatattaacccttaatgttagcaagtaagttagtttttaagtttgtgtttgtccccttaggttaagtttgtaagaacgtatggcacg

SEQ ID NO: 1525 - DNA, 312 bp, Primus virus
  isolate Ferlo, complete genome.1
gaattagaccaacggggagtaggtgagttcctctcctctactagagactgatatagcccttaggtttcatcgctttgatctcagtgtgcccaaattaatagtaaccctcacatcaaaggggaaaatctgccccatctattttatcgttaacattcgcgtgtctacagaccctatactatatctatttttttagcttacattttaatccttgtgtgatttaaagagagaggtgatagaactatgagcccctcttgatttagaaaaaaccaaccatagaagacaaatataaactgcgctcacctatttcataaa

SEQ ID NO: 1526 - DNA, 312 bp, Beihai picorna-like virus 107
  strain BHZY60580 hypothetical protein1
gttacccctacgtattttgtttaacattaatgaaattgaagtgtctccgcgactttcaattttattcaaccaatgcaagttatcaacgaaagttagttagaaagacataatacacaatttagatgtattggcgcttagtcaccgcattagtgttctgtcggaatttagacactaattattatattaattccattagagcgcatgattttgtcatgtcctttatccacccgcagaattggatatgcgaggtgaggtggtttaaacactcgtccgcgatttgaaacgccagcgaagtttttccacaattaaacc

SEQ ID NO: 1527 - DNA, 313 bp, Bivalve RNA virus G3
  partial genome.1
cgaggagttatggaagtctcgtaatttaagtgaactcgaattgttcgagggtcttgaagagcctgagattaagccaattaaactcgtagaagaaaaacaagagaagaaggcttctgtattattcacttgtaatcgcgagaaacgtgttgataagatattgtctggtcatactgaactcgagataactaaatctggttatcttagatctccagaagaggtatgcggaattattaggaaaaagatcgagagcagaaagaagaaaaaggccgatcttagaagagagcgtgaaaatagatccaaagagaggggtctt

SEQ ID NO: 1528 - DNA, 314 bp, Plasmopara viticola
  lesion associated tombus-like virus 2 isolate2
tacaaaaacagattctgaaactttgtcccaagctgagcccattggaactagctgaatttccacttcagtacgtgggtaagcaacggacgaggtatcagactgccgtcgagagcttgagtgtcaagagcttgagacgcgccgatgcgtacaccagcaattttacgaaaactgaacgtacgctcaaggccaatgcagtacctagaaacatctctccgagaagttataggtacaacgcccaggtaggacggttgttaaaaccggcagaaggtgtcctacttgatggcattgcgaaagtcttaaacagcaagaccgtg

SEQ ID NO: 1529 - DNA, 314 bp, Picornavirales N_OV_080
  putative non-structural protein2
tcagctatgtgatacattttgcggtttgtatcgcatagaaccgcggctaagagtttcggaggtccccgtgaccttactatatttatagtaggaattagatgattccacaaaaccccaaaaatgagtggtttatagcattaacccacttcattcaattatagtatgctcctgacaataataataataataataaagggattaacattggccctcctaataccaatgtaaatagtcgtgttcttaagaactcgtctacctgtttgaagcaggaaacactggcgtttcatgatggatcgtcagaatggaggaattct

SEQ ID NO: 1530 - DNA, 314 bp, Wenzhou tombus-like virus 5
  strain WZFSL67420 hypothetical protein1
cgagggtttatcactaggtaggataggagccgcacctatcttttcagggaacccaccctgttagccactgttaccagcgaccttcggaaagtcgtgttggatggtggaagggacaagcggattataaacgcctagccgttagccagcattgctgggtaggaacgcaaactgctttgcagtaggaggtgtgtagacaccactcgaggacagcgacggaggggctgtccacggcccacgaccgacgggcgcacaagaatcggctttggtgtccctccctaatatgaggtgacaaatttctcccatcttctctcact

SEQ ID NO: 1531 - DNA, 315 bp, Persimmon ampelovirus
  PBs3 RNA, complete genome.1
tcagttttgtttggttgtatctcgcgggagttaatccgtaagagaataaccaaacaaaactgactttcctcttctttgctttcccgtctttatctttcacgttctcttgctgctttgcgattgcttgttcttttaggacccccgatcgctttcctttcttaaggctttcttttcgttacgtgcttctaggttttctttatcgtttcgccttgtttttcttttccttgctttttatctatttctgcgtttttctctttttacgttctgcttttattttattttaaagggcttttcccacttgcttcatgctttacc

SEQ ID NO: 1532 - DNA, 315 bp, Casuarina virus
  isolate 0071, complete genome.1
aagtaataaccccgtccgtctagcttagacgaaaaacttagcttggaaatctagccacaacagttgctataagaatctctcgagacactctcccacttaacatcttctaggaatcttgctgctacaacaatttggctagtaaacgaaaaattcatacagttgtaagagacctttggtccgtacttttgaaattttgtttctaatatatataaatttgaaaggagggggtcttagcattgtctaagcactgcctacaaccctagcgaatacatatacattagtatgaatttgttgtaatcgtcctgataagacaca

SEQ ID NO: 1533 - DNA, 315 bp, Cherry virus Trakiya
  isolate PAI 2-29, complete genome.1
cttagaatgtttcttaaaaccttgccaagcctgaggattttaccatatcgatttcgatcgctgtgataatcttctcactttccccccaccctcccatattgtaattgaagcggggagttttgattgcaattgtatagtcattcctatttaggatacggttggactttaactaatcctccccccagcctattagtctgtaatgcgaacgctaaattggctgtgtaaatttcttgcattaacaatccactacacaaacaaaatgtttctgagggtcctcaaacgaccagcccccaggatatacattcaccagacaaa

SEQ ID NO: 1534 - DNA, 315 bp, Wenling scaldfish picornavirus 2
  strain XDXMC61459 polyprotein1
gtgacaaggtggatggcatgccaccacctatgccccctgagtaaagcaattctatgaccttagactgatcttgattcaaccgtaattgtctaatccaagttaaataaccccaacgtttcgtcgacggatgtggagaaactttgaaatacaactaaactcgtcgctcttgctattttgtagcacaagagagtctagcctctggttgattatatttcaagactgcttgttgtggagaagttaagccattgggaatgggacacgtttgcgttatccctggatattgccgccctttggtgaagctcatgcttgggatgc

SEQ ID NO: 1535 - DNA, 315 bp, Hubei virga-like virus 16
  strain arthropodmix13816 hypothetical1
aaatattagccaactgaacaaaacttagaactatactataacctacaactaatcctataacttactttaattttatttcttttcttttgtttgttttgttgactttgctaatatttattgtgtgctttcttttatcccaataaccctcagcggggctctgccttaattaagtttcatgtaacttgttttatccttttgtggtgttagttttaggatcgttttattgtagtattatttttatattcattgtttcttttgtatgttcttgtggtgtttgggttctctgtgttttataggattatctactatgtaatt

SEQ ID NO: 1536 - DNA, 315 bp, Beihai picorna-like virus 43
  strain BHNXC41212 hypothetical protein2
actaaggtacgggcttacaccataaagtccgttaaaccaaaatgtggtccttgtacatagttactgttacttatttatgaatcctacaattaaaaagtaggtagagcgtggatgtacattgtaatcttacctgagcgctcctcgaaatccctatttagggatacatttttggttagagtgtaaacaattttgtaggtagttctaggaattttgagtcgtatcctagaattaacatagagacttagtgtaaataatagttttgaaagcgacgccagcgctaaaaatactggaactgtttttgatggttcagcccac

SEQ ID NO: 1537 - DNA, 316 bp, Point-Douro narna-like virus
  strain mos172gb29666, complete genome.1
ggcgcacaaacgtacaccacgacggatattcgctcttccgagcgatatctggagtgcttgcggttttgcgccagcccgtagtccggattcccctgcgaaagcaggtgcttccaaaccacatcggcgcaaccgtgccaggtcggtgcgtcaaactattcgtttgaccccggcggcactctgttgtgtcctccctcttccccactggcgagctaagctgctaaacgcaatcgatgacgcagatgcgggcgagaaagctaagaaacgtacgaaagtactgtattcgaagccaactcgcgtcaaatctgcgccaacctgt

SEQ ID NO: 1538 - DNA, 316 bp, Marmot picobirnavirus
  clone c220589_g1_i1_libraryA_2527 segment I1
gaagaaaggagaagcactatggagtgtttactaaaacatctgaaaagcctttcttcaaccacttcaaagttgcctttggagtatgttggagtagaggtagagaggaggtggaaatgtgaccaccaatcaaattgagtacaataagttactcgaaactcgcagaactaatttagctaatgaagctgaaactgcgaggtcaaacagggcgcgggaagccgaaaccactcgcgcaaatcttgcttctgaagccatacgagcccatcagaatgcgattggagaagccgcaaatgttattaattccaatcactatgcaaga

SEQ ID NO: 1539 - DNA, 316 bp, Rose spring dwarf-associated virus
  complete genome.3
atatttgcaaatcacggttttgtttcacggcaaaacccaaaacataagtaagatgggcctaactagccctgtggagaggctaccccttgaataagggtagtggttgcacgtcttggcccgacagattccggccgaccatgcttctgtggtatacactgcaccagtaagacctggtttaacaaaactttatcctacccacgatgagatgagtgggcggcgtaaactttgtggaattttacagagaaatctgtaattctgcacatgtttgcgagaggggtctccagtacccctttatagaaataagcgcttctttggg

SEQ ID NO: 1540 - DNA, 316 bp, Black queen cell virus
  isolate GS1, complete genome.2
ttttcttggcgtaattaaaaccaacaatgtgatcttgcttgcggaggcaaaaatttgcacagtataaaatctgcaagtagtgctattgttggaatcaccgtacctatttaggtttacgctccaagatcggtggatagcagccctatcaatatctaggagaactgtgctatgtttagaagattaggtagtctctaaacagaacaatttacctgctgaacaaattaatgaaaattatgaaaataaacaacaacttgttgaacagactgaaattaccacctttgaaaacgatttgatcgtgcttgaggatggaccgcaa

SEQ ID NO: 1541 - DNA, 317 bp, Sclerotinia sclerotiorum hypovirus 1
  strain SZ-150 hypothetical1
ggggtgatgggaaacttacgtttcgccaacgttaaggtactgtgattttgtacttacgactcagggtcgaccttaactggtttatactctgtcgagtttgggcaaatagctagactatctccccgggttttcaggagcccttagtgtctggctgacacggtctggaatctctttttacgtctcacttacggcaaatgtgaaatcgcctactgatttagtagaagaatgccggcccgtgtgcccgcattggcaaccgtgatgcccggttttccacttttgggatagggcttccctccgaaaacgggacgaaccaaaat

SEQ ID NO: 1542 - DNA, 317 bp, Beihai astro-like virus
  strain BHWZXX13371 putative protease,2
gtgggtgttgtcctgaccccatctgcccctacaacgcgccaacattactgtatgacatcaacaggaccaaaataaatgactatgttacgcgcgagggaaaaacacggctaccgacccaagcatatcgacctgacaaaccacctgctggattggaagtgaatcttttcttaaaaaatacaacccagtacaaaccctcttattgggatagtagggcctatgaaaaggcatgggaaaagttcacttacgccaatcctacagagctaacgcatgaagacatcgaatttgcaaagctcattctagctgatgagtatgactac

SEQ ID NO: 1543 - DNA, 319 bp, Permutotetraviridae sp.
  isolate H2_Rhizo_Litter_8_scaffold_8011
agccttaaggttgaacgggtactcctacatttaagcatgttttaatttacatgggcgggtttggaaccgtcgcagtaataatagacatgggtggatttgaaaccatcgtagtctcttgcttatctaagtagatacaggattgtggtctgtaccctagaggaatgccaccatgcggtaaaaccctactccgtgccccctgcacgaaaccaggatctgaggtctggttgggtgaggaactccaaagtgggaagtccagtagaggggatcattgcctctacatttttcagaagaaacaactcacaacaatacacatactaag

SEQ ID NO: 1544 - DNA, 319 bp, Hubei picorna-like virus 6
  strain WHBL73048 hypothetical protein 12
aactacgagggccgggtaagtgtcctcaacataggttaacaatggaaaagtttcctctataaataacgaatttccactgtggcattggttaccattcgagttcatcgctgtgtgtggaatgcgaagaggcttgtcactttatgaaccgatttttattggtagcgcagttgtatgtgagtaatgtggaaacatatataaaaattataacattgcagaaacaccaaatttaaatataaagcccacaagcgaggaagggctagttcctcgcaacctgtcagcgcccgaaaggacgttcgatattccaactctaattgacgat

SEQ ID NO: 1545 - DNA, 319 bp, Hubei tombus-like virus 38
  strain WHWG56034 hypothetical protein 1,1
tttgtcaattcatggggagttggggtcgagaattgattaaaataaagtcgtcccgacaccatgggaataaaaattatatatttaagcagatgcctatagagctatgcacaaaaacaccgagcctgtgaccattggcgatatatctgtggcgtcaccaccgccacaacaaaaacacgtcccgtgaccatgggaataaaaatttatattggtcggtatatccaaataccagcgtgatgtttcatgttcatgtatgttgggtgcggcacccggtggttggaggaatggaggaggttggttaacataattcccctatctgaca

SEQ ID NO: 1546 - DNA, 320 bp, Beauveria bassiana RNA virus 1
  complete genome.1
gttggaaaatagcccacaccccccccgccgggcgggctatttttccccggggcggcgggactagatggttgctagggccccgggcggtggtggtcgacgaccttgtggggtcgtcgacgttttcatttgtcttcatccatgcctgttctgatttccttccgttcgatttgttgttttctacagtcagcacctgttccttgctgactcgcctctcccatgggcgagttgtataaatacatgggacgtgagagaaccgtgctggatacctcacgtacacccaaagtcggtacggggatcgtaaccattacgctttttcctta

SEQ ID NO: 1547 - DNA, 320 bp, Fulton virus
  isolate CHABV1/NYC/2014/M026/0243 segment L1
agtagttaacaaacgcttcacaacaatcatcgattacttgctctctcaatatattgcaaaactgaaaaaataatatttctcagcaacctatttcaacgaatttgaaataactaataataaaaagcaagccaaagcaaagaaatctaaataattcacttctaaagcaaaggaacaaaagaaaagaaaagaaaacaaataaaggaagagaaacaaaacaagataaagtagataaacaggtagaaaaacagaacaaagaggcagaaagaggagagtaaaggctcttgtagagcattaccgcattaataaggcccacaaccaaa

SEQ ID NO: 1548 - DNA, 320 bp, Anopheles darlingi virus
  isolate MAC, complete genome.1
tacttcttttctttatttgctttttattcatactcatatatcatcgtattcaccatgcatgatgtggtgttgattagtgataggtccaatatcaatttgagaaataaggcggagatataaatatgaaaaatggaaataaaaaacataaaatgaaaaatgaataactccaaaataaaaatttatagatataagtttccaatcatgaggtatttaggcctcgctaacctcactattaagaagatttctaacctatttttaaaaacccactagtagcagattcaagtacccttctgtcaaacatcttgaaaagattattcgat

SEQ ID NO: 1549 - DNA, 320 bp, Beihai mollusks virus 2
  strain WZSLuoI86113 hypothetical protein 12
gtcagcttctcgaaagcccgccctgggggcttctaataccgggggccaccgcaactatgcgttggataagctaaaaatagttgcttgtgtttgattaacgcacaggttgtaggttctgaattacctgcaatttgtggacagctacacaagtagtcattgtatatagtcgttatttagcgacggggtgacgcccacaaaaatagcactgtcatgttgtcgattgatgcaccgctcatgatatttgtacaaattgcattacttatctacataaaattttggaggacggtaccctcaataaaaataccgaattgaacactact

SEQ ID NO: 1550 - DNA, 321 bp, Knope narna-like virus
  strain GudgCC_DN40323-16 RNA-dependent RNA1
agtatacactccactcgactaccaatgaaaggaggactattatgtcccaattcatttacactcagaacgaccttgtcgaagtcgatctgaatgaattcgatcaagggacgcttattcttgcgctccttgcaatcgaggcgcaggtgcctggcacacttgccagcatcttgcgtcaagccgcgttagctaacggggggtggagaatatcctccaacgtcagcaatccggggaagtccatcaatgatcagagggactttctcgcttggatgagaaaatttcaccaagccctgcaggaagagcaggcagaaaggagtgtctgag

SEQ ID NO: 1551 - DNA, 321 bp, Beihai picorna-like virus 7
  strain BHNXC41478 hypothetical protein2
tttctttcattatgtcctgggatgacattaaaagcatccagcctctcgtccatgtcgtgatgggttatacaagcgttatttttctacatctcttttattaaacgtgccttaacttcatggatcggttccaggtatattaacaagcctgtgggcgggtatttacccgcggccattatgattacagatgctcattcctgtatttcatataaaatcctaaaagacatgtcctgccagttttccgagtcacgaactggtttatgtatacactgactttctttttctatttctaatatcgcgcgatgcatatcgccttataaatat

SEQ ID NO: 1552 - DNA, 321 bp, Xinzhou dimarhabdovirus virus 1
  strain XZSJSC65538 hypothetical1
ctatgcccagtcctggaacgagagagttaatctatcaggatttgatagatcaaatgccctctccaacaatgttgaagggaccagacggtttaccaataaatctcagttggaaagatctgatgagtaatccggaaaataacttgagacaaatcatatccagcatcggaactgatgcatttttcaaactatcgttggaacaaaagatttttaaactgcttgatttggagcagatggcagttgacgttttagacttaatgtccgttgaatacatgtaatcggtgaaaccattgttgaaaaaaactaaaatgcaacacccctcac

SEQ ID NO: 1553 - DNA, 321 bp, Riboviria sp.
  isolate rtr167pic3 genomic sequence.1
cctataattatgataaccgcacgcaacgaacaagggcttttgatgaactgatttagttcggttcaccgacagcaagattttacgaaatggatttaacttaccacgcaaaccctcagcggaccgcaggtattttgatcgcactggactctttagatcataacgacaagattggatcatatccatgtagttaacgtagactacactaaagagattttaagcacggtaatgtaatagaaattacccgcctggtaaagcaccaaaccttcgtggcagttatggcctagtcacgattgcatcgagccatttactcaatgtatcaca

SEQ ID NO: 1554 - DNA, 321 bp, Wenzhou shrimp virus 4
  strain WZRBX43306 hypothetical protein 1 and2
ctggactaccacccgtctttcactgcagacgttaaacactgtgccgacctgagggttcaggatgtgcgagcgtgtgatcttgctcccagcgatattggacgtaaagtcgctggcagtactgctgcactcattaagcacataggtgggctatttagtccagagacgcctcgtggcagtcccacaaagtctcaccccgtcctcgggccgcagcgccactgggcagtgcgcgcagctgacatagcgatatgtcagtgtggcctagaaaagataccgcctgcacaaccaaactcaaacattcaaactcaagaccaaacccttagt

SEQ ID NO: 1555 - DNA, 321 bp, Shahe tombus-like virus 2
  strain SHWC01c3797 hypothetical protein 11
gggggcctagttgccacacatgggttcgacactgatacagctgccaatgtcagtggtctgccaattacggtgtgtgtgacatctgggaccccaaaggtgcgcaaggcattggccttgccaggattggggctgggcgtgcaatttggtgtgcacaaccagtccctcagaaatgtgctgcgcgggttggtggagagggtgttcaaggttgtcaaaaatggcaaattggtatctccacctaaacccgtggcgaacgttttcgataagttgagtggctttcgggcccggttgttacgtgtggtgggttcatgccgcccttggact

SEQ ID NO: 1556 - DNA, 322 bp, Mud crab dicistrovirus
  complete genome.1
gagctcggtacccggttttcactccgtgcacgattccattcactatctattgagcttcgatatcactctgttttgactctagttatactacactcaagcacactgatattatcgttctgatagtttgtggtttcattaaaagtgtatacatttatttatattaaatactgacactttgcgggttaaaatgtttaatactatttttcaatttgaggttgtatgagataattttgatttctatgttatcattgaataagggagtctggccctaattgatgtacgactcttctttggttgcgacccgagtcccttctacatcaag

SEQ ID NO: 1557 - DNA, 323 bp, Marmot picobirnavirus
  clone c70636_g1_i1_libraryA_2670 segment I1
ctattttctattttattctagtgttctttacctattccaaggtgaacaccaattgtagcagaaaatttacactagtagcacacttgcaagcggtgtggaattagtgtaaagagatagctacgcagcaacaaaacatccacaaatgtcacgtccaaggaggtgaaccctaagtgacaaacaaccagatacggtactgggagtatcgtgagacgggtcggcacaaccaagaaactgaacgcgagacaaatcggtccaatctagctcgggaagctgagacgaatcggtctaatctagcgagagaagctgagacgcgtcgctcaaac

SEQ ID NO: 1558 - DNA, 323 bp, Potato virus X
  mRNA for 12kDa nonstructural protein, 8kDa1
ctacttggaaacatcatttcgagttccgaggaaagtggcagatttgatagcaggctgtggtttcgatttcgagaccaattcacaagaagaagggcacttagagatcactggtatattcaaagggcccctacttgggaaggtgatagccattgacgaggagtctgagacaacactgtccaggcatggtgttgagtttgttaagccctgccaagtgactggacttgagttcaaagtagtcactattgtgtctgccgcgccaatagaggaaattggccagtccacagctttttacaacgccatcaccaggtcaaagggattgacat

SEQ ID NO: 1559 - DNA, 323 bp, Peach associated luteovirus
  isolate PaLV RP19, complete genome.1
atgggctctgtcacgcatccggttttgaatccccttttaccattttgggattaccggatatcgtggtgcgtacaggggccgtccctaggaagagtcgtagtgtaattagctacttgagtcagttttctttaggtttagacttccgggttcccaacccttctctgcacaatgcccttgttgctgtggaaaggagagtttttactgttgggaagggtactgatgttgtacttccattggtacctagtcatggcattttcaataagctcgcttatttccgtgactccataataaaagaagtagggttctgtaaggtacatagtcca

SEQ ID NO: 1560 - DNA, 323 bp, Xiamen fanray pesti-like virus
  strain XMTSYG10372 polyprotein gene,1
tgcaggccgcactagcaattttccaccactgagcgacctgaactcagaccaatttctgacgggactgtcagggcaacccctgtaaaacgaacccatacgggtcggggactaacgcctgaatggctacctgtctgggtttggcctgatcaaggaagtctagtggtgcagttagcatcaactattgccggttcggccttcgggcagaacgaccctcgggtaagacgtagggccagggcatttggatagcacaatgggtgcgggatgtgcagctggtaacagtttcccccaccgcgtttgcctgtgcataaggttcatgtgattcc

SEQ ID NO: 1561 - DNA, 323 bp, Beihai zhaovirus-like virus 2
  strain BHTSS12281 polyprotein gene,1
ctttctacaagaatatactgctattaagcttcctctcgggttttttactaaacgcgggaaagatggtatctctgcctaccataattcgactaccggcagaaatttgggttgcaggtaagaagaagaagaattgacaatcttctccttcgaacaataacctaatcaaaggtcacagaactagtgataaggagtggttgctttaaaatctacaccttaaaaccagttaacgtgagccgcattatttctaagggccactagatttggacttgggtctcgagaaataatttgactatcctaaatagctagatcgtgaaacggcaaat

SEQ ID NO: 1562 - DNA, 323 bp, Beihai picorna-like virus 124
  strain BHBJDX18598 hypothetical2
attgacattcttcatgaggtcttgccattttcctatctcctgccttttcttcttcatcctagacccttactcattaatatttactccatttaacatccctttggactttacagtgtattattgcactggcccttcaactagggtcaaacctgcctgatttgatatcatgctctaccacagggagagcaccctcgaacacgccatcagtagcagtagccgaagccggggttatacctcaatacctaggtgttgtatatgatcaagcttcggccgtagttacagtaggcgagcaaacaacaccaggaccccggggagaggctgca

SEQ ID NO: 1563 - DNA, 323 bp, Beihai picorna-like virus 31
  strain BHZC37445 hypothetical protein2
atacgtggccttgccttgggtgcaggctttaaacgcattcattcccgtgacgaggaattcaagtagtcgttacttaccgatgctgtcggtaataaagtaaaatcagctgcaacatagaaacataacggtgttccgatgtggaggtgaattgccacaatggagcatgacaggctatgattgtaaggactagggacccgagccctgaggctatttagtctccccgcattgtcctgtgggaaaaagttaccactcgcgtatgtcagtttgcacctgcgtacgatgattttgtaaatattgctaccgaaactaaacaaatttttagg

SEQ ID NO: 1564 - DNA, 323 bp, Wenzhou tombus-like virus 14
  strain WZFSL15005 hypothetical protein1
ccgatcgtttatcggtgagcagcggctcacgaaacctagatagaccaccagaacaacggtacccccccttctccaatcataagaccctcgctttttttctcgctctctaataatcgtatacggtctaggcaggtgaacgcaataaacgccctttatggcccgatcatagaggaggctttaaagcaagcagactcacatttcctgtggatatacagtagagtttgcagtggactcataaatccatgagttgttgatgcgccaacacaaaattttgccacaaaactgaaagagacagtaaacctcagtaccagctgtaaacttgg

SEQ ID NO: 1565 - DNA, 324 bp, Beihai picorna-like virus 34
  strain HOU158088 hypothetical protein1
gtcggcttctatggcccattcactggggccttgtaccggtggccaccgcaactatgcgttggataagctaaaaatagttattcacatttgattaacgcacgagttgctaggttctgcattacctagatcttgtggtcagctatgtgaatagtcatgtatatatttccattttttagtggaggggtgacgcccaataaaatagcactgttatgttgttgattgatgtaccacacataatattttataaattacattacttatctttatactttaaacgaggagagtgtcctcgataataacactgcgcctctcactaatttgaga

SEQ ID NO: 1566 - DNA, 324 bp, Hubei tetragnatha maxillosa virus 9
  strain arthropodmix140491
aaagcagtgaaaaagtttttggatctgtcttcctgggcatcacatgattggactctcattgagggtaacgtcgcggcctgggagcgctttcttgataatgtattcaagtgtgagtatgtttctgaaggtgtattggtgaaaagtggatttgatttaatttatcatggaaaaacgaaatggtctgaagacatatggaagagtatttctatcgatcttgaaatccgtccaaaatttaagttatatgaagagtgtatcaagcggtcgaggagtgttccggttaatcctagagctatttaccttgacacttgggaaattaatgaaaag

SEQ ID NO: 1567 - DNA, 325 bp, Lychnis mottle virus
  isolate Andong segment RNA2, complete1
ttgaaaagcaatctgcgaactttgttactatttgttctcctcagctagttattggacttatccaattctctccgttttcgcacttactagcactgggcttatccagatttccttttagtacactctcactttgcacttccagcacaacttaattttccttggtgcttttagtgcattcacaacgtttactttaagcaatctcgcttccccgatttgtcaagttaggggtttttgtttttcctttgttgtcacgcagcaatcttttactcttttccttttctttctaattctttgttatattctcatcccaccagcaatccaaaat

SEQ ID NO: 1568 - DNA, 325 bp, Soybean leaf-associated ssRNA virus 2
  isolate SaSSRV2-1, partial1
gaagttggaattgatgagggagacttcatcgttgcggctgcccttgcggggaatcttacgggtcgactgtccagggtcggttcgcatgggtgacctcatgtgggatttgatgttcacaccacatccagaaagcatcttggcgccacctcgtcgttagaggtaccttcacagggcggagcagaccgttacaagccaatgcaccagtggcgcctttgccgtaggtgtagataaatttacaaaagtggggggagtccaaccagtacatacactcccatcagtagtgatctgggtctggcatactgctgccactttccaattcttaatc

SEQ ID NO: 1569 - DNA, 326 bp, Black grass cryptic virus 2
  segment RNA 1.1
tacatggggagataaggctcactcgactctaagcgtcgaactctcatcaaagcctaatctcacctcgagcgccgatcttcacttctgaagctctcctcccgctcaccactcgcaatggatttacatcacaaagctcttcgcaaactcggaatcaaccccgattcagatcctggactcgtccacatctacaacgaaagccctccgccccgttttcaggtcatcctttctataaggagaattatcaatcagtcgtcattgacgcactcaaagaagtcctcccatcagaagacctagatatagtccttcacggctatttccgaagtccc

SEQ ID NO: 1570 - DNA, 326 bp, Cnidium vein yellowing virus 2
  isolate Yeongyang2 segment RNA2,1
ttgaaaagcaatctgcgaactttgttacgatttgttacttccagctagctattgggcttatccaatttctttcgtttccgcaatcactagcaccgggcttatccggatctctttttgttttctttgttacctctgttctgtgcgcgctttaattttcctttgcgttctttacagcagtcacaacgtttacattaagtaatctcgcttccccgatttgtcaagttaggggtttttgtttttcttttttcgtttcacagcaaacttttgctcttttccttttctttctgctcctctgctatatagttcttccccctttgatttctaac

SEQ ID NO: 1571 - DNA, 327 bp, Diatom colony associated dsRNA virus 16
  genomic RNA, complete1
tgattcaagcacaacatcgtagacacgatcttgtggttgaatcattttaataaaacttcgcgtaccaaaaacgcgtgtgcatacgcactaattctggctgtcgaacttcggatcggctgaaatttgtccgcacccctctgttggccgggggggtagacgtaaaaacttccagaggtgaccctacggggatcgtggctcttgcgttgtaagattcgcagtgtgttacaagcattcaacgactacacgccacgggagagaaggaatagtctggcctcatcgcgcacaaagtacgaggaagaattgggtatttccttcatcgagcagata

SEQ ID NO: 1572 - DNA, 327 bp, Unknown
  Description of Unknown: Mutant Zaire ebolavirusisolate Ebola4 sequence
gccaatctcccttccctccgaaagaggcgaataatggcagaggcttcaactgctgaactatagggtacgttacattaatgatacacttgtgagtatcagccctggataatataagtcaattaaacgaccaagataaaattgttcatatctcgctagcagcttaaaatataaatgtaataggagctatatctctgacagtattataatcaattgttattaagtaacccaaaccaaaagtgatgaagattaagaaaaacctacctcggctgagagagtgttttttcattaaccttcatcttgtaaacgttgagcaaaattgttaaaaat

SEQ ID NO: 1573 - DNA, 327 bp, Avocet picornavirus
  isolate MW13 genomic sequence.1
gggggccgcgcatctttacggagatgcgtggtccaccggcctgtttccccattcccctatccctttattttgcccatattgggcattaagatcggatttctcaggtttgacgcggattgggtaatggataaggtttggtgtattgcttaggtaatgttataccaagactgtagcagctagactagggggcacagtgtttatggactccattggatatcctgccctggtaggcactcactgtgtacgggaggttgggaagcctcgccctggccctagactgggtgatagcctggcgcttgctgagccagttgcttacagtataatcag

SEQ ID NO: 1574 - DNA, 328 bp, Picobirnavirus sp.
  Equ2 segment 1, complete sequence.1
atttgtataaatggcattctgatatgcagcgttggctgaagcgtaacctgctccagcgttagccattccagtagcataattggcttcgatttgtttacgataattactttcactggctttgtttgatcttttagtttcattttctatttaaatctcacaattctaaaagtcttagcatggagattcacatgcgacacaccaatgagtgaaattttagtacctatcaaacacaataggaactacatccagtgagatttcgtgtagcaagcgaagttaagcaggatgaacaattattatcagtgttaaaaacattcagaaaggaggaaag

SEQ ID NO: 1575 - DNA, 328 bp, Calhevirus 3
  clone V11B putative nonstructural protein,1
cgctcaaacttttacccaacaatttgaaggtcgtcgtaatgcttcgaatattgctcagtcattcgacagtggtaatcgtatccaagttaacagaaacgccaatgttgttccaacccaaacgttaagatgtgccccgagcattcctcaagatcagactgttttggccgatggtcgggttgagaggcgtgtccgggatgcggcccaacaaattgctattgtgaataacaacgttcaatttgagacttcatggaaatcgtttgtttatgtcctatgtcagaatgggtcacaacctataatcgatgcctccacttcgattgagactggtcgg

SEQ ID NO: 1576 - DNA, 328 bp, Wenzhou picorna-like virus 35
  strain WZRBX39547 hypothetical1
agggacactccctacacccaaattcataacacgcggcggattctcgtaaacccctgcatactcttagaggcttgtagcttaatagcgcgtttccttatgtgtgttatttccctttttctccccttccctttttaagttcttagtaatttattgctctgaactaaatctcgtggagattcattatcccttgtctatattatgcattgcgaagctttgataacaacagcgtcaaggtacgacgatcttgtaaatatggactttaaacttcatagctatatttatagcgagttgttgttggtagttatagtacgaatctaccagtaaaacc

SEQ ID NO: 1577 - DNA, 328 bp, Hubei orthoptera virus 1
  strain ZCM21319 hypothetical protein 1 and1
tatagagcgaatactctatatacaatatacagacctaagttggtggtattcatggtctctaaataaagcgaaaccactacgttgtgcgaataatcaaattgcggcagtgaacccagagaacggcaattctgaatattagcattcgatctcacctaagtttcagcttgtgtttcatggtgattaaataaagcgaaaaacaagcaaaatttttgttattaataagcaaccccgaagcatttttgagcgaaagaaagttattaatacgagtattatcgaagaaaccattttagctaatactccaggaaataacgtttatcgcccaacaaca

SEQ ID NO: 1578 - DNA, 328 bp, Hubei toti-like virus 12
  strain HC21305 hypothetical protein 1 and1
gagaaaggaaaaacgtgtctccctagccatggattgaattcacggaccatggttagtgtggtgaaggcgataccgtgagtcgatcctcaaccacccttcggctggtgaacctgtgggttggaagcccactgggggtggacaggtcgaagtgtaaaaaatccacaaaatttcctctaaaaatcaaagtgaagatgacgcattactcgaagtgatacgtaacagcgcagtgaaacagactcgggaaaactttgaacaggaggaggaattcactgtggcctcaggtgttgcctttttggcggcactgaatgcccgatattctgactccgta

SEQ ID NO: 1579 - DNA, 329 bp, Picornavirales N_OV_064
  putative non-structural protein2
gctgtgatgttcggcttcggccatgccaatcagcggctgtatttgatcactattgtacttaataaacatatcatacgagtatatttaacagcattacagtgtcagtgggaacagcttttcagctgtactgattcttaaccgcccatctttaagacttagcagtctaatagggtttgaatctgatatgtacgcctagcaccgggtcgaggcacccagctagatcgttttaccgccttcctaacactactacatcccagcctgccggctctacaggcaccgcatccgacaaaggtgccgaggaagttatttccgccgacaattttcaagtt

SEQ ID NO: 1580 - DNA, 330 bp, Wenzhou tombus-like virus 14
  strain WZFSL15005 hypothetical protein2
tggcgctacagaagttacttagcaacttgtcgtgatgttagaattggtaacatacaacgaccggatgttaaagtaaatgtcgactctgttggcagccataaattttctaaatactattcaatattccacagcaacaatttaccaaagtggttttattacaacaaatgtccttgcaacgaatatgaagccatattaaaacgacactgtgtttcaacatcatgcaacactactcatccacttttcctaagagcaaaggctgtatctaatgagttagcgacactagttcgggaagatttactcgattataggccattaactcataaagagctt

SEQ ID NO: 1581 - DNA, 330 bp, Changjiang tombus-like virus 19
  strain CJLX57318 hypothetical1
cttacttctgggggaaatacaacggatattttagcatgccgtttcgcgacagaagtttggcacagagtgccgttctagccgtaacgtctctgacaaacggtgaggtgcgcgtgagagcactagtggtgggcaaccgcgggtccgcaaggacttgtgtagcaaagcaacttcgacgtctcgtgtcaatctgcaatacggttgactaaagttgcgctaacccggctacacacattcataagtatctcccataacaccccggtatgaggccaattgcgataagagccaatatttttagcacgaaagcacggaggaaacggagagaaatccata

SEQ ID NO: 1582 - DNA, 331 bp, Atrpec virus 1
  replicative protein and structural protein genes,2
atccagagctaggagctctctctaatcgccgcaaggagggagcagcaaagtccggtctctggtcttcgttttagaagggcggagagtttcggctctactggctggtgtgtgccgcctaaaatccaggctaccagctcggcgcttttgaccagatccgtttaatcgagcgactgggagttagccaactcaatcgattgctacatcacaaaatcaagatttgtcccatattgggccgcaagaagacgttcagcagatcacgacattcgtcgacgattctaacatccagtcgtacgaaaagccacatatatcatctgtgactgcatggacaaaa

SEQ ID NO: 1583 - DNA, 331 bp, Lychnis mottle virus
  J genomic RNA, segment RNA2, complete1
ttgaaaagcaatctgcgaactttgttacttttttgttttccaaaactagctattgggcttatccaattctcgttacttgtttccctcactagcaccgagcttattcggattttacttggttctctttgttacttgtttttaaaaaacgcgctttaattttcctctgcgtttattacaaacagtcaccacgtttaccttaagcaatcttgcttccccgatttgtcaagttaggggattttgctttcaattttttgtctcacaacaaactcttctctttttcctctcctttttgttgctttgttatcttttgctccctcccctttattggacg

SEQ ID NO: 1584 - DNA, 331 bp, Sanxia picorna-like virus 1
  strain SXXX37713 hypothetical protein 11
cttcatcgggagcccgttgggctcctaggaggtacagccaagtgacaggctgttttgtgttttacgttgtctcaaaaacaagttctaagactatttatgcttttatgaaagcaccgtatgtgtcattgtatattttaaaaattataaaaatttcaagaaatgtgttactgatcagattagttaatcagaactatgggataatgttccccgtttttggccatttgaatgttatcaaaccccagaaggcctagatgtgcggactaggagtcactgtataaattcacagacataggacttgcccccctgtgtactagttaagcgatttattttt

SEQ ID NO: 1585 - DNA, 331 bp, Beihai noda-like virus 5
  strain BHZC36307 hypothetical protein 11
cccggatttagagcagatcgactacgccctattaatagggtgtcggttggtcttgctcatagccggagcggtgattctgtttaatttgcagcggaaagtgttgagaacgatctccatcaccaatcctgttcgacaatatgtaatcgagttgtctaagattaaacagtaccctgacgatctccgaaagaaatttcggaatctcaatgtcctcaagtatgctccgtctttgaacggtcatagccatggtgtgtgtgccgcattccgagctgcggccgatgataccatcaatacgtttatacaggaaaacggttttgaggtttactcggtcggc

SEQ ID NO: 1586 - DNA, 332 bp, Wenzhou qinvirus-like virus 2
  strain WZRBX42684 RNA-dependent RNA1
aaccactgtatcaacgtaggcatgacaactgactctacatgttgaggcaactccaattcgacgttacttatttctacctctatttttaaatcctgcagtatctcttcttcattcagtccagggggccgcaagtccaaagtgccgcgggcacggagatggccgccttgcctatggggaggagggatgcattgaaggcatagtccggagaatggtagtgccctgtcggtgtcggaggagacggagcaatcaggggaccgcgtctggcacaggcaactggccggggcgatcccgacagtagttcgctggcacaccgccgtactcgttaggtccaa

SEQ ID NO: 1587 - DNA, 332 bp, Wuhan Mosquito Virus 8
  strain XC2-7, complete genome.1
tcgaaaggtaacatcgagtacttataccatatacatgccattaactagaaagtaagtttaatagtaaggaccatccatgtaaccgcatttattagaatattaagacagttttaatccatatagtggttttattgtaaggttttgtagtacttagagagagttttaagaaagagttgaacgtggacgatagattttggatctcaccatacgagcttgcgcgaaccctaccccaactcacctcccctccccttcctatcctcaccctatcccccaatccgccttttggccttagcggattggtttaaaaacaacaagaggtggcccgagggcac

SEQ ID NO: 1588 - DNA, 332 bp, Jingmen picorna-like virus
  strain JMYJCC71227 hypothetical protein1
tgtgtttttgtcaagataattgttctgtgattaacagtgattgtggttcgtgtaatgcgacgcagtcaaatgctagttttgatgaagtgtatgagagagtggaaaacttatctcataagaagattgaagagtgtgtagatcaggctattgatcgagcttctaagcttcgtgattacaagcttaatgttcacaatggctcccgacgggaatcatctgatcctctctttatttcgccccattcgttgttatcgcttggggtatctaagtttgttgcgtttgagcagcatcacagtttcgcttcagttgagtctctgaagttgcttgctctgtct

SEQ ID NO: 1589 - DNA, 332 bp, Riboviria sp.
  isolate wpk049shi06 genomic sequence.1
gtgtataagagacagcatctctcgtttgcccgccaaaaattctggtagctagcgaccgcccctgtttcatcttcacccccgaagggtggacactaccggaggttcccacatacccacatatgggtatggactccgcctcttgtgtcaggaaaccggagagatcggctaaagctgccagcccttcggggtcattgggaacggtccttctcgacgattttactcggagaaggtccgcgcaccgtgccctcggagggcgtggtgcgtagcaatcgaggctcgtcctcctttacactctcattcaaattcgcatagatcaatacacgtataacaag

SEQ ID NO: 1590 - DNA, 332 bp, Hubei tombus-like virus 11
  strain WHSFII11317 hypothetical protein1
cggcaagtacatgcgattccttttcgccacgttagtggtttttgcttcactacccaaaacagaagtttttgttttggggccgtgctatgcacgaccattcccactaggtcaggaatggttgctatgacctaccatatagtagagagcggcacagggggggttttacggcaaagcccatatgttttgatgttttaaagaaatgtcagtaaaaaccgtgtgccccggaggttgtattggtgtatcacatagtgctctacatcggtacctcctcaggatggggcacggagttacaactccgcaatggcgacctacattaattggtcacaaacctt

SEQ ID NO: 1591 - DNA, 333 bp, Botrytis cinerea negative-stranded RNA virus 7
  isolate BCI7_Contig41R
cagggatgggagaggtgggtcttttttgaccgttcatgaggctctggccgtctacctcttccagccctgctgggtggatacagcatacctaattttgaaacatcaactggaatcttagaaaaaagtataagataaaaacggcctttatcatatcgagacctgtataccacccaaacaggtgacgatctacacgctactctatctaggaaatcatcaatcaattaggaccagaaattgttacctttaaacaaaaagtaataacgttaatcttgtatcgttcatctagcactggtataatcttataacaaactagcgaatacaggttaatttaca

SEQ ID NO: 1592 - DNA, 333 bp, Sifaka hepacivirus
  strain SifHV_H5-L75 polyprotein gene, partial1
agggtctgcgcctgtacactcccccacgggaataacaccagctccgagaaagtctgacgagtatcggtgttaaaaaggtggtgtgccctaccaacgtcataacgggtcgtgccgatgttccgaggcaaggactaccactgggtgcccgtgggaaaaaaggggcggatagggagctggggtgaaccgaacggccgtagacggccgaggtcacaggcatgggacgctttgagcctccgtagcctggttggatcttggattcccggtgtagctaccagtttactgcctgatagggtgcgggccagcgcatccgcccttctggttgttcataacgcc

SEQ ID NO: 1593 - DNA, 333 bp, Bundaberg bee virus 3
  isolate QLD-7 nonstructural polyprotein gene,1
tgtactaatgtgatcttgcaactagaagtaaataagagatgtaaaaattttagttgtattgctattagtataaagaggttggttatttaaccttacttccaggatgcctcgtgagcagccctcataatatccaggaaccatctctcgagcatacattataagtgacatgtatgctttaaattcgaaaaccttggtgcaggttcaaatgttaccaacgacaacgactcgaattaccatgaccagaaacaaattatttctttccaaaatcaaggtcaaacggtagctgatgaagctttgccaaagattgtagacttgccaaaatcatatttagac

SEQ ID NO: 1594 - DNA, 333 bp, Culex pipiens associated Tunisia virus
  strain Ayed, complete1
cctcattatagtaatattatatctcctgaatactatgtctattttgatggttatagtggaaaacctcatggtgaaactctttccgatttagatatatataaagcatatacaacatattacagatatattaaggaattttcagaattttgtaacaacgataatgattctaatactagcaatattattgaatatgagaataaggttagaaaatccacgaaggctaaggataaggatttaaaaaccaaaaactttcctgtgtttaatccagcattacaagaattgtataatacatacatcaaagataaatcggaagttaataaaaccaggttatta

SEQ ID NO: 1595 - DNA, 334 bp, Salem virus
  complete genome.3
ggcagttcatcgtgcttaggaccagtgctggatcactttctccaccttcgcccagcacccacaggcctcaccatcctatctctcattctcaaacagcaccagtagaccagtcccctcccacagaatctctccaataaagaccatccaaaatcagtctttccaccacatttgtctagtcctagaatttcaatattccattaagtatagtaattattattttaaaaaacgtagacctactaacctcttttaaaacagcactcaggacaagaaagaaaattaggagcaaagaccaaactcctgcgatctcatagatcaagttctaatttggtataca

SEQ ID NO: 1596 - DNA, 334 bp, Jingmen tick virus
  isolate JMTV/Pteropus lylei/Cambodia segment 3,1
tttaaatcactcttagactcactttacaaactcgaagataaacaggaaaagaaacaagtgagttgttcatgaacttgacatggctgccccagtggtggcggccttgagctgcgtattaggcgggctgaggcggtagcatctgctgctggcaccagaattggtgttaggaaactcaccatgagtagaaaccagttacatacagcgccatttccgtgagatactccccaccataggatggttatctctggaatatgtggcgcccatcgacatcgttctaaacgaagaagacagcccttaccaacttgacaggaaggtttacgagaaagccctagca

SEQ ID NO: 1597 - DNA, 334 bp, Ginkgo biloba picorna-like virus
  strain pt112-upi-2-NY genomic1
gtttccacgagtcatagctttatctttaattccttgcatatttattttatatcagcttaatggagttagaaagacttcatcaaccaacatatttccttctctgagaatagtgcggtaatcctccgtactatctttcagtgaatcacggctttcaaagattagaaatgctatgagaataatacttttatatatattatatcattaattataaataacaaagtttagatctaattttgtccccttgaggaaaagacagaacaataaagaccagtccacttaacccattggaaagctattttagaaatcccttggcggtggaactaattcgactaaa

SEQ ID NO: 1598 - DNA, 334 bp, Wuhan arthropod virus 1
  strain WHCC81862 hypothetical protein1
attgaattacgtacaacgttttaaattgcactgcgtataatacgtttagtgtaattggctgcgatcttattggtctgtataatacagttccaatacccaaagtcccccccgtgtagctcacggggttttattttccgtatatttacggctccccaaaatatttcgtatagcttacgaatgccaatatttttatttagtttaaatagatttttaatttggttttgttttatattatatatttgttttgctctctttgttagttttatcaacttatgtttacgttatattgtagtaagtgtcgcaggcccatttgggactgtatttgttaatttta

SEQ ID NO: 1599 - DNA, 334 bp, Wenzhou picorna-like virus 37
  strain WZSBei69579 hypothetical1
gttttgtagctttattcttcgtgtaatcgtagaagttgtgtgtagaatacttcaaatatttattgagatattcaatgcgcgatttccttctcctaaacaaactatacaatgaggtaagttgtatttttaatgttgggctccacccctatgtgaagtgtcgactcacatagtatttagacatacggttttcgttttgtagcaaattattggcgatcaagcaagagagacaaaccaattacctgtctcaaacaacgttgagttaggtggttggaacgaattggaagtatctactacacgtgagactgtagaaacttctattagtaactttaaccct

SEQ ID NO: 1600 - DNA, 334 bp, Marine RNA virus SOG
  complete genome.1
tacctgtgattccttgttgtctttgacaactaaatattcactaagagaatgatctcactagacattctcgaattgggcaagcgcctcaccatcgcttgttccacccgcgcccttgcactcatcaacgataggcagagcatcggaagctatcactcattgtttgacaattgggtgacgctcctgatgtttgtgctgcttatcaatgttgtagcgcaagttaccggacgactgcgcctcctaccgggccctcttcagcaatggattggctgcctggctgttagggttatcgtgttcgatcaactgtggagggtgttccactacttcctgccttgca

SEQ ID NO: 1601 - DNA, 335 bp, Aspergillus neoniger ourmia-like virus 1
  strain AnOlv1CBS 115656,1
ccgtttgttaacccagtttactctgggggacacgatcggaggggttcgccgggagactctctgagttcggcgtccaacgagtcgttctttggaaaggagcggcgagtggggcctgtggatttggccgtcacacacgttaacagaaacggcatcccgcaaccaactcgtaagtggtacctactcgaaggtagggggatcgcagtgtcctgttcgggggcttccccgggttcgcccggtgtcggagccacaagatctttgtggtcttacccgatcaacaccctctggcttgccggtacgcgtgtgccacaaacacaactgccattttatattttaaa

SEQ ID NO: 1602 - DNA, 335 bp, Hubei picorna-like virus 24
  strain WGML142000 hypothetical protein2
acttgctaaattacgtaaataagggagttataaagtagtttagtattgctatctctaggacactgttggctatttagtcttaatgatcaagatgcagtggagcagccctctaaaaatctaggtcacctccctagcgatagttaggatgatccacctacgtcgcgaaataccggatcgctacaattaaacaagatgaaacatctcctcaatctcaaaactatgaggaggcaccacagataacccagactgtggaacagcagcaagagttaattacttttgaccaggataaagctatagtggcagagcattatccgggagaaattaattatcctcgt

SEQ ID NO: 1603 - DNA, 335 bp, Hubei toti-like virus 2
  strain arthropodmix13450 hypothetical1
agccgtggtgggatcaggcattggggaggactgatgcagatgaaataacattattgaacacaattcctgtgcaaggtggttctcataggccaaatagcagtaataataagaataaagataaaaaaggagaatttgtgaaaactgtgaagctgaccaaagataatataccggtatggtgtagtataaggaacaataatataacggtggttgatagagctaaggctagatttgtactggtacatgtgtcgtatgaaaacacacagggagtgggtggttttggtgctcataggataggtgatgtggtcgttaatagtcatgccatacaacttgatgat

SEQ ID NO: 1604 - DNA, 335 bp, Hubei tombus-like virus 16
  strain spider58816 hypothetical protein1
tagtacccaacttgacccacgacagtaagacagtaacattcataccctacatcaatcaattcggctatgcaagtaacgtacactccagttgtgtttgcaatgaatatcgtgccttggtcgatcgccacatcacagatcgcacatacatcaagtttgatgccaaggcctggcgagaagccgcccgtcacacccttaaatactaccccgggggtgttagtaaatgtagttacacccagatcatcaatggctacacgggcgggaagaaggctatctacatcaaagccctagaaggactgcgcgcgcatggtttacgaccatccgataccagggtgcgc

SEQ ID NO: 1605 - DNA, 335 bp, Beihai levi-like virus 22
  strain BHJJX24892 hypothetical protein1
cttacggcctctaagaggaatatcctctccggctctcgccggtcacctatcttacgatggtgatatcccataaccagcaactataggagagaagatcatgaaagacaagagccttgcggagattgctgtatcttcgccatactttgacgaatacgacatcaatctctacgtcgcaatgctcgaaatctctcttggtctcatcgaacctacagacgctgtttgctcataccattatggttgtgtgctcgcagctgctgagttgttgggttttgactggtccaaccagttgaaacttctccccagtgtcccgtccgaccctcttcacggagggttcc

SEQ ID NO: 1606 - DNA, 335 bp, Beihai narna-like virus 14
  strain BHJP52694 RNA-dependent RNA1
ccggcggcacgcgtgagcgtgctgtcggtgaactcggtggcgttggtgtaaaagccacgtcccgtgcctcccgcctgtctgggctgactacccaggcaggtgtaaaaccagtttacaaatcgaatcaggattcggcgcttgctagccagggggctggagacatccagcccaaaggcaaggaaacgcggaatcctgctcgtgggaaaggcataaccccgagtgccaaacatcaacgtgtttcgcagctcagaggcttcgcaaccgtgatcaacttctggttgtctcagttgcggctccgctgtagcctgtcggaactccaggatcacttcacggaa

SEQ ID NO: 1607 - DNA, 336 bp, Culex mosquito virus 4
  isolate OTU50 RNA-dependent RNA polymerase1
agttaatatgaccggtcgaacatcaccctggaattggggaagaactaccgtacttaactaaccacactagtatataagatatatactatatacccgcatttacataggaagataaggattttaaactattttgtaagttgatgttaaggtttaatctgtaagctaacagccataacagtagaaataagtttgccatatgttgtgtttcatctctttgtttctggctcttcaatccttgggtgtactgctgatagatgctcctctttctacaatcgcgctaaactgcccctccccaatctaccttttggcctcggtggattggtttaaaaacaaact

SEQ ID NO: 1608 - DNA, 336 bp, Avian avulavirus 20
  isolate AAvV-20/great black headed4
aacatatgtatcatctcgctcatgctagccaggatattgtcataattatgtagattacatatgtttcaatcatatgtcactattgtagtgtaatcaattcgcgatggtactgaattatcatcttatattccctggacagatttccgaaattgacaacatactctcttacgccaataaacgaaaatatctgattacggtgcaatctgtattcaattctaaacagtatatacacaatcatacacaagatagcttatttggattgttttacaaattactcactcataattaagaaaaaatcaaagagaacttaccggtgggggcgaccccaaatcaata

SEQ ID NO: 1609 - DNA, 336 bp, Lasius neglectus virus 1
  isolate Cambridge-Lne, complete genome.2
ctccctttgggtttgagtcgtcaggctttgttctcgaagggtcttgatggtgattcgtcccatccccaatatagctgtgaaatgcttgagggccgagaccatgtagggaaaggtaagtcgagccgataagatttgacaacgctatatctgtgcattaaatatttatccagtaccaaaggaactcaagtgtaatgctgacctagacaagtcttaggacgcgctgcttgaatacattccttgtacgacactcggtggtgatcgtaatttggtcggagttaacctctggataatatttgcccgtgtcggagcggtgatatagtcggcggactaatttac

SEQ ID NO: 1610 - DNA, 336 bp, Ginkgoaceae-associated picorna-like virus 1
  strain pt112-dic-10,1
agattggctgtgggtagcgcataccacgttaataatatgtgctagcggaaatagaggtattttagagatgcgcacatgcttgactttgccggtgtgtctcgaacgcgcgtactactcacacgtttatggagaggagcgaagtccgaagtgcagtgattgagcatccgcacgggtttatagcttacaaaaacagaaagtgacgtcacgacacaagacgttaaatgtgaagagtttgatgggttaactttaaaccctactcctgagctacttggagtagcttcctttagcaatgaagctggtcaatgcgcggcaattaaggctacacagtactattcg

SEQ ID NO: 1611 - DNA, 336 bp, Wenzhou tombus-like virus 7
  strain WZFSL44625 hypothetical protein1
gaacaggagagtaacgaaggtggtacggccgctacagaggcgcctcaccttacaaaatctaagttcaagcagcaggcgggacggccaccccgcgaactaataactggtgttgatcacaacacaaacgctattattgagaggcaggactgcgtgtccatcgtacctgccttggcagccagtcagaagatccacgatatcggagttggaacttcggacaatgtagtcttgaggattaataacgctcggaagagaaaagtgaatactgatcctcttgactcatgtgtacaagcaacagagtccgactgtgagaatcctctaggattcaggcgggttcgg

SEQ ID NO: 1612 - DNA, 337 bp, Wenzhou Crab Virus 1
  strain RBX2 nucleocapsid (N), glycoprotein2
ctgtatgaagaatttacaaaaactgacaccatggagaaatcattcaaagagtgggaagagcttctcaaccagagacccccctcctcgacacctgcaccccttgtggagaccaggttctactgggagggtcttgtaatgggactgcttggagctgctctggtgattgcactctgtggaattctcaagcttgtgggatggaggtactgtcgcaatgtgattagtacacctctctagggctgagatgtccgggtgggtgggtgggatgggtccattgtggtgccttctcgtggcgggcctgtctagctaaaccacaactataaaaaaatgacaatacaca

SEQ ID NO: 1613 - DNA, 337 bp, Lactuca sativa marnavirus
  strain pt151-mar-12, complete genome.1
cccgatatttggcataaacctcgatgacacgtctagcgtaatggctacgctggatgcgacatgtaaggttgatcaaccgtttcaaaactaaagctgctagctgcgcacgcgcgtagtacattggcctctgctctttttgagcatgttcacctctggaccatgaatcacaagtgacagctttttaattgtttttgatcccgttgagataccccaagtctcgctccgctggacctctatctgagagtaccgagcaggtgaaagcccagctcagggaggtaaccctttattccaccgggcctcgtcccacaacagcacaagaatcagatacaaccgaaca

SEQ ID NO: 1614 - DNA, 337 bp, Bole hyalomma asiaticum virus 1
  strain tick109109 hypothetical1
gaattatagtaagattttctttgcgacttctccctgcgtttgtgattctacagtcatttctgctcaactttgttgctgcggccgctgtggacacaattttatttgcagagaatttttccttggtgaatgtttgcaattttatttagttttgtaatagactttgcttattattcattttcaggttactttgtttgtaatatttatcaattttgctctgataaagattacttgtcgcttatattttccttcttactatacactataattcttgttgctctttgtttattaagtttttgtggtgtaagttgttttatattcttattattagtgcttcatt

SEQ ID NO: 1615 - DNA, 337 bp, Wenling levi-like virus 4
  strain WLJQ103632 hypothetical protein1
cccctcccggggttctgcatccttatctattactagataggttgtcctttcggctcttcaaccacctaggaggcaatcatggaaactaatttaagatttttcttaaccatagatacatgcactctttcagaagatgaaagagagtatctaaaaattaagttaatcataaaatttcctgaatttagaaattactctttctgcaaccactttttaggcatgctacgattccgtgttttttctacgggtcgttacatgtacttaaaagaggctatacagaatttgtatcctgaattcgctgatcgcatccggtttgacttccaaacagacggggtctggc

SEQ ID NO: 1616 - DNA, 338 bp, Wilkie narna-like virus 1
  strain mosWSCP70929, complete genome.1
gcaggagtaaagttaagatcatccaagctacatacctaagggacgtagtcggtgaccgaaacaaggctttctacagactattgcctgttctgaaagccctgcaaagtgaaggagctatcgatcgatacctctaccacttaccgtccggagatctcctatcggagaagtaccgaggacagtctattaaagaccaaccttgggaccggccggaaaagttcttcacacctgatcaggctgaaggacttcgaagaatcttaacccgagatatcggattaaaaccccgagtcaccaatatcctgatctcgcgaccgcgagttcaattcaatcgaattcaggat

SEQ ID NO: 1617 - DNA, 338 bp, Sclerotinia homoeocarpa hypovirus 1
  strain ShHvLT11, complete1
gttctaattggaagttccctggtaaaggtgcacctgaaggcattcaagataaatccagttttggcgagggtgtattagagcctgccaaatccgaaggtttattttactatcatcctgatctgatttctactccagtgttcaaagtactaactgtaggcaaaggaacttgggctattggctaccttaaatgcgacgatggtttagcgccagtgcattacgatgcggacattgaatctttctatagcttttcatattctggttatacttggctcaacgattttaaatcgagtctgacatctggaactgagttgccaaaggacaatcctggacatgtgcaa

SEQ ID NO: 1618 - DNA, 339 bp, Lutzomyia reovirus 1
  isolate piaui segment hypothetical protein 11
tcttcctactacttcgtgtctgtcgtcgttcgtcggttctgttatttaacaatcttaattcatgtcattttcatcaaatctgtcgaatctttgttgtggagggaaggaggattctccacagagcaatcaatcagagaaaaatttcgatttcgtaaacgagatggatcaactgattcatggaccgacattaactcattgctagaaatcattgattatgaaacaggttcacaatatccaccagttccaaacatcccagatgcgttactacccccaaattcaacaactggcgtaaatacacataatgtcaatcatcttgttagtaatattctttgcactagt

SEQ ID NO: 1619 - DNA, 339 bp, Raspberry mottle virus
  isolate HCRL Glen Clova, complete genome.1
cgttttctccaaccatttcctgtttgtctgtcgtcgagccagccgcaaacagtttctatcaccgtcccctttatcttttcggtgaatccccttataccctaaccttcgttggttttccgcttttacccgcacgtccccttcttttcatcctttcggtgaaacccctgcaccctaactttcggtttttcgcctttttccttacgtcccctttcgcgccccccctttttctttcttctctttttctttggttttgttttgttctccccttcctgtcccctttcccactttctttttggtttctcggttcttcccccttcttctgttttggctttagccaat

SEQ ID NO: 1620 - DNA, 339 bp, Kotonkan virus
  complete genome.1
aaataagtaaataaattaaactaaataatctaacaaaacacacactaaagacttgtaaacaatgactatatactgacttctttattgttaatagttagagataagtgagacagtcgttaaagtatccaaaatttgaggtaatatgtcttaaggagaataatataatcaaagattgactaggcactgaccgtaaatacatcagaactaaagtacagggggggtgatggctgagatgaattgtaacttgcaggtatataaaaaagaaagaactataaaatgaattaaaacaactaaattaaaataaaggagaaaagtaaaagaaaaaaatcaacagacctc

SEQ ID NO: 1621 - DNA, 339 bp, Beihai picorna-like virus 22
  strain HOU126951 hypothetical protein2
cttccgctcgctctgccctcggatatggcataaaactgtcccccccgtcgatccatgggggtccggtgtatagttgaagagatccgtgttgtattggataccacgcaagtagaacggttttatcgttctttctaaacctacttgtacgaaggcttgcaacacgagggctgctcctattgaggagagcgtacccgcgcaccgagaaacaacggaccttctgggttgggtgacccaggagtgtatataatatcacctactaattcatatttcataaattttatagatagatatagtagaaatacacacccgtcacaggaagaaattgaagtggctactgcc

SEQ ID NO: 1622 - DNA, 340 bp, Rinkaby virus
  isolate OTU75 hypothetical protein, RNA-dependent RNA1
ttctatattacttttaaagtataaatggatattcgtaggtacttactccgggagttttcaaccctctcctggattgctatcgtaattttcattaacgtgattattctggttataaactatccctcaccacagtacataggcgaaggtcgcgttacttggcgtggtatagtttacacccagcaggatattacttttgtctgtcgcactagcaccaccgtttgcgtttttcaatcactcatttcactaatcattgctctgggttaccctttgtacccaattggaattgttgctgcttttatttatctgcttaacaagtggatttatttcctaaagcttcgtt

SEQ ID NO: 1623 - DNA, 340 bp, HVAC-associated RNA virus 1
  putative polyprotein genes, complete1
agcgcacaagaagagaacgataggagctttatgaaatcaccaagagttgacaaaaggtttcccaagtttggtactaggttttgtgagagctcaacaatgaaaaccgcactaggcacgttggggctggctatacgcaagtctttttgtcaactcttggtgatttcataaagctcctatcgttctcttcttgtgcgctttaagcaaaacccccttttcaggcttctccgccttctaattgagagagttataggctcctccccctactaatagtgaggaaattatatcgtatacttgggaccattgtaagtcgctaacgcttttgttagcccaggatacagcc

SEQ ID NO: 1624 - DNA, 341 bp, Diatom RNA virus 1
  Chiba4 genomic RNA, complete genome.1
tgattcaagcacacaacgaggggaccctctcgtctgtgtttggattaaataaaaacttcgccaagcaagcggtgagtgcatgtgcacatattccgggttcgatttcagtggtgttttaccatggattcgttctgtatttatccgagcctcttattgctttaggggggtttcgtacaagctgccggaggtgagtctacggattagtagtggcttttgcgttgtaaaattcgcagcaggtaataccctgtacactgaactctacgccactggaaagaagaatgagtcggccttaacacgtgcactaggtgaatacttacttagttcatcttcgagataataca

SEQ ID NO: 1625 - DNA, 342 bp, Picornavirales sp.
  isolate hbl169shi1 genomic sequence.2
tttcgtggatagcggagtttccagtctctttaaaatggtgacttcaggaaagactggaccgtgtgagtatggcagccacacggatagtgcccctcaaatgtttgatcatcatttgttgtatgggaggaaagatcctctgttggttgttgaactgcttgttatgttggacggaagcgggagggtcgagtgcgaacccaactaagctggagaaaacacagcatgccggtgatacgagcgcaagatttagtacaatttattcccgatccacaccatatttcccccgtattaatttacacatttacggcttgcgtggttaattccgcaacatagctggcaccagtc

SEQ ID NO: 1626 - DNA, 342 bp, Warroolaba Creek virus 2
  strain WRCV2 205660 hypothetical protein2
attaaaatgtgatcttgctttcttatacaattttgagaggttaataagaagaaagtagtgctattttaatatctaggttaactatttagttttactgttcaggatgcctagtggcagccccacaatatccaggacaccctctctgcttcttttatgattaggttgtcatttagaataagaaattaacctgctaactttcaaacaaatactagtaacattgaagatgaagaccggaaaattacttccgaacaaaaagagattgtacatttttctagtgaaggagttacccctagtaccactgcggtgcctgatatcgtcagcctttcaacagattatttgtca

SEQ ID NO: 1627 - DNA, 342 bp, Weivirus-like virus sp.
  isolate zftfla02pic3 genomic sequence.1
aatttaaacaagctcaaatgttttattccgacatttgggcttttaaaacaggaatagggttgcaacctatagcatagaagaagtgtatatggttacaagagaaatgttgctgtcgctattcgccgtgctttcttctatatttgagacagttacacgagttatttacgtcgactcgttgaaatttaacgcgtaacaaattttacaaataatgatcaaaattttataaaacaagaacaacaaacaatagatattattgaatctgaaggctccactcatgtagagaatcgagtggcgtctatatccacaagaacaacacaggttgctaaggctgtccctaatcaa

SEQ ID NO: 1628 - DNA, 343 bp, Magnaporthe oryzae chrysovirus 1
  A gene for hypothetical protein,1
gcaaaaaagagaataaagctttctacttttttgctccacacacgctcgactcagatggctgctcaaccaaacagaggcttcgactcattcttcgcagattactacgatcaggacggcttctcagatctcaccagcgtacgcgcgtccaccatccggccggcgaatatagtcgtagagccggaccacacggttttcgacacctaccgcacacacggcgggagccccccagactacacaaccagccaagtggcggacgcgttcggccagcgtgcttcagcaagcgacagggttcacggagtgaggagagacacagccgcttcagtgtacagcacgagaccgtacg

SEQ ID NO: 1629 - DNA, 343 bp, Solemoviridae sp.
  isolate ytb135shi04 genomic sequence.1
tccataggaagcccgcacagatcagtaaccatgccggtctcaggtaccccaccacgcatagcgtgaccaagtaatgctcacatgcaaaccgggccacaaccagcgagatggcaaacactatctcagcaaccttccagatcgctaggcaggccggtcctaaggactgggcccacgctagggtcactctgggttcaacaaagtctcgcacttggttaataccttccatctttttcttgacttgtggaacggacaagattagtacaaagaaagaaagtgatatcttcaagaatctaacactcacaaatatgtacggatcttatccgttccacaagtcaagaaaaag

SEQ ID NO: 1630 - DNA, 343 bp, Kelp fly virus
  complete genome.1
caaccctgctggaactggatcatcagaaaaaggagaagaattaacacctttcgtaccactagatcagatttcgtttatttcacgttatccccgaaaattgccctctggagtgtattctggtgctcttaagaagattaccattgaaactttctttcactggactactagtacaactaaggaacatctaggcttactattgtcactagcctcgtttgaaagttgcttgtgggaatcagaataccattcagctattacaaaggaaattgaaaatttattgtcaaaatttaaatatataagatcttttgtctatatctatgacagagaagttgtagcagactctgtc

SEQ ID NO: 1631 - DNA, 344 bp, Atrato Chu-like virus 5
  strain Psal 1739-1 segment L cRNA sequence.1
cgaaatcaattactttaaaacttatatgttgaatttataatgagtggtaaaagcgtagatctgagaaaagttcgccacatggcaactactggcaaccctgtgactaaggtcgatttggaaatgattatgaaggagttgatggagatcaagagagagatcaaatcaatacggcaactaatagagggtgcctcatccaagaggtcaattagtgaaccaactgctcctactttggccctctcagaagttccgtttcatatgagatttaaataagggaaatgaaaacaatcattcttttttaaaaaatcttgagtattttgttggtaaagcaggaatctttgtggaaa

SEQ ID NO: 1632 - DNA, 344 bp, Beihai tombus-like virus 12
  strain BHTSS17936 hypothetical protein1
gtaacgaggtcgcgctggtgtacccgccactcgccggagtccgaggagcagtacgctccctcttctccttttgcgggctctcctcgctgttcgcatggttaggttgctgggagtaccagcaaataccggtccatgtgcggctcgcctccgagctgcgatcgtctacggcgttcagcagtatatggacggcgcgaggatttgatgccacggcgctgcagttcagagtgcggcgcgcggaagctattgtgaagcgcaacgagtggaaagtaacaccgggtgtggtggaaacgacggtggccttcgtgtcggtcgaacaaccgagcgaggttgacgctgtccggttc

SEQ ID NO: 1633 - DNA, 345 bp, Wuhan insect virus 26
  strain WHZM10161 hypothetical protein 1 and1
ttagcaagaaactacgctcaagtgacagaggaaggtaggttcacgttggttaacaacagtatcgtaacagttaaacaaggagaatcttcttacaggtccgatctgtccctatcagcagacttccagtttgctggcagaaatgtaaggacaaacacgagtaacgtccacacggactactcggggtataacaacaagtacatcacgtcagatggagtcttcgatgctgggctcgcactgaccgagtttgcaagaactacagcggagagacgtctcgtaaaagaagacactttcagcttactctctcagcaaactcaagctgatagccacgaatctttcatttacaac

SEQ ID NO: 1634 - DNA, 346 bp, Marmot picobirnavirus
  clone c1336805_g1_i1_libraryA_2521 segment I1
aaacattgtagtttacaaatctgagaaaggagaaaccgcttatggttttacaagtaaacatccaatttacacacatccttagctcagccattagtggtctgagatttggagtaaatctggatgtagaaggaggtcgaatgtgacccgaaatcaaatagcttggtatgaagctagagaagggaagcgtcacaatgttgcaactgaacagctaggagttagagctcaaggtgagactgaacgatcaaatcgtgcgagagagttagaaactatacgacacaatgtgatcacagaaggtcaaacagatcgtactatccaggagcaacgcaggcataatataactggagag

SEQ ID NO: 1635 - DNA, 346 bp, Beihai picorna-like virus 105
  strain BHHK79817 hypothetical protein1
cgaggggcgaatcccctcgtattcttttcaccaattgctaggtatactgggactcttagaggcggtaccgaaactatatatcatgatagtgtgtgggactcttagaggcggcactagattttgatatgtattgcatttggcttttcttacttcttcaaatttgatgttgtgtttaacacctagttaggattgtgtctaagtaactacccgtcctttggataggctctgcttattgatacgtcaaacctgggatgcggattaagaattgtgcactctatggacatggctcgaacacgatttgttttgacgacactttgaacccacactttggtcctgcgaactatat

SEQ ID NO: 1636 - DNA, 347 bp, Beihai picorna-like virus 49
  strain BHZC36855 hypothetical protein2
ccctgtacactggtccaggcagatcggtgtgcagtaatgtaccgtctcagaggaccccatgtttggctcagaaagtacttgagccccagttgatatctgtcactggaagtacagataacttctatggaattgaccgaccatatgattttagtaggtttgaactgcagtcggaggtggttgatgatggaaccgttccaagcgtttctgaagaagaagttgtacaaacagtttcttttacggataacgctagaggcgtttctgtcgatctgccaacctcaacgaatgcagtggctgtcgtagataatacggacgatattggtttaggaacttttttgtcccgtccagtc

SEQ ID NO: 1637 - DNA, 347 bp, Beihai picorna-like virus 63
  strain BHTSS17878 hypothetical protein1
gttcctgatagaacaaaacagtttattatgaattcgtaacatccaggtcaacgagcaagaatagagtgaatgaaaagaccgattataaatgtaggtcgttcagtaattcattgatacattaaggtcgcctaacacccttgtatatctatttttcgttctagtaagttggagaaatgttatcatgaaattttaaatttgtctagttttaccgttgtagtgacggaaacccctgcagaaagaaatattttcagagaatacaggtatcaaacttattattttctatatctaaaaattttaaatattattattgcctaaattgaattgtctcaaccttaacttttaacaat

SEQ ID NO: 1638 - DNA, 347 bp, Changjiang tombus-like virus 7
  strain CJLX49320 hypothetical1
ccattgacgtcttgctcatggccttcgattgggcaagaccttggttgtaaccggccagtagggtgggtgtgcgcagcatccagcccgagtgtgcgggtgtgtggcgtgctggggagcttatgcttgtggagatttgcggtcatttagggacgaggacctaggtgcgagcaatatcctagagagccaacagcgatgacctaagagccataccttgatcactgaccagcacagggggattccaccgcggtgtggcgctcatcccggggaccggcccgtgtagagtgtatgaaccggataaaaccccacgaaccagccacaacctacgcaacacgatttgctacttcaac

SEQ ID NO: 1639 - DNA, 347 bp, Matryoshka RNA virus 1
  strain MaRNAV-1.2 RNA-dependent RNA1
accctagggatgttgtcggtgtggggtattcacccttttacgattaccttccggtactttcgacgaaagtacaaccggatgggagaagacttcgtctttacaccatcccggagggaaccatacttcaacgttctcatggcggtcaatccttaggaaagctgccatgggaggggggaggctccttctcgacgagaaggaggaaactccttagagttgtactcacaaagtccttaggcctaaggcctaccgttgtggatatcctattgacgaggtcaataaggcattttcaacggatagagggagccatcaatgccgtcgtcgacagcctagtgtgctctgaccctact

SEQ ID NO: 1640 - DNA, 348 bp, Diatom colony associated virus-Like RNA Segment 6
  genomic RNA,1
tgataaatgagtcaacgtcacaactggacacggaaacaagaaagcgattcgcaccctcgtctccagtgctggcatttacacgactcatagtatcagctgattgatcccttagctgcatactgaacgcgaaccgggcggtccgcagggtgccaaataaacgagtgggaacagctactttgaaaggttgttgtttggcgggctgcacttgaatccaatgtggtgatggttgggataatgtacactagtcactaatgcggagacgtatttaaaataatatcacagttgaaatgcgtaatatgttaagcatattaagtccgattgtaacctgaacaaggccaacttaatcgg

SEQ ID NO: 1641 - DNA, 349 bp, Chaq virus
  strain MARplus0002 hypothetical protein gene, complete1
ccttcttaagttcttaagaaagaataaaaactttccatccggttttggaataccaaaccactttctatcgttcgttgaaggtttttgtgttatcacaaaacagaacgactgctttttggaaatccaaaagctaacagcttagtcaagcatactaaaaacttggaataccagtttttgcctttaactactagatccatgcatttaaattgcacttataacatcttctacagtagttaccactgcgatttggacgattttacgatccgtgctagcagtgaagatacttggcaagtattaatttttaccacgctatttatcctgtccgcttttatattcattgtcttctata

SEQ ID NO: 1642 - DNA, 349 bp, Shahe picorna-like virus 9
  strain SHWC0209c12638 hypothetical2
gctatatacggggctaacatgtaaaaatgctaaacggcatgttagcttgaacggataaaccgaaagcgggttgtttaaccttactactcagagcttatcagagagatttagcaacttgtatgaattgggcgattcatgcatgtacatatagtctgctacaataacaaaagaaacaaattgtaatgaaatagaagggatttctaatcctactttcactgatttaacaggcactttggtctcggcaggtgttgcaccagtttgtgctgagattccttacacagtgccatcatcttttatttctacttctgaggtgtctcaggatttgagagactatttttccagaccaagg

SEQ ID NO: 1643 - DNA, 349 bp, Cylindrotheca closterium
  RNA virus 02, complete genome.2
tcactccggggactttaaatccggcccagttttaaatctgaaggtaagcaaaattaatgtatgcatatggataccaagtgtagtgtatatttgtatgttttgtaaactagcttaggctttgcatatttaagggtccgtactgcggaagagagatctgagttccccctgctcaactgtaaatatacccttccactatattgagcgtagttagtggattgtacatagttcgttcggtaataattgtaaaacttacattaacatctgtcgagatgctaaaaacgacgtcgaggtcggtactggaagccgacctttgattgaggtaaattccaacgcccatgacaaacctgaa

SEQ ID NO: 1644 - DNA, 350 bp, Soybean cyst nematode virus 5
  strain ScV5 polyprotein gene,1
aacaacgctaaaccctcaaacttttaatcaccacaaacaaacgaaacaatggcttcgaccaaagttttctgtgtgcgtgacgaggacgcgattgcggaacgtgctgccttgctgagcgacgtaggtctcaaaaccttcatgtcggcaggagcgcgcaacgctgagagggccgccgagtgccaatcggagtgcatttaccgtccaacggtcgagcctctgactgggctgtgctcaggcggtgatggtcacagtggcacccaccctaagcccactgaccaaggagaagaggcggcaaacatcgtcgtcgggagtgacccttctggcgggagtacttgcctttatggcatggc

SEQ ID NO: 1645 - DNA, 350 bp, Beihai picorna-like virus 8
  strain BHNXC41454 hypothetical protein2
ggaacttcagaccgtcatgtcttaaaactgtctggaggcctgcctaggtcgtcattactccaaggagaaaccaaaaggcgtgctatgtactggatacctgatccttcttggtttgtggttttgccaggagtgtcttgcttgcatagttgatggactgtagtggtcgaggctgtttagcttcaggtgtaaagtcgccatcagtaaaccactgaaggcagttgtgctgatccgcgcagctgaccttgagaaaaataaattggattactaacttatatacacttttcaaagagtcctgggtctctcaatacctagggaacacggacggattcttctttgacccctgtctcgag

SEQ ID NO: 1646 - DNA, 350 bp, Wenzhou picorna-like virus 52
  strain beimix75583 hypothetical1
gtcgtaaaatattttctacgttaaatttctttcttcagatttcaaacgttgctgaagacaaaaccagagtttgcacatactcttaaatcaatgtacatgctcccttaattgatccggagcttgataggattttgtggtcctattctcaaatactgtaagaacggcaacagtacacaatatgttacattatcatttaggtcagaaataccgagttgattgaagcagatatacttctgtgaaatccactattagcatttagtggtcatgtctttcaagaagacacaggcttaggtccttggcgtgccaaaaacaacagcctatattaaatagttgtttgaacgtcgtaaaca

SEQ ID NO: 1647 - DNA, 350 bp, Changjiang tombus-like virus 10
  strain CJLX21891 hypothetical1
gttatccttaaccacagcactttgtgacccttcagggggatatacctgtatcattcatccacgccgtcgaaagagggcagcacgtatctgcacagaaggccagccgtccggtggtggcgggtgcatgattacaaggccagcgggaatccgccctttgcggtaccgctggctggcaggtgcatgagcaccggtatgtgctgaccggggggccccattggggcccccccggttcattgatttgggatggcagggccccaacgcctgctccggtcacccatggtcggttatttccaatgggagctttggaaatttgggctcaccaaaccatttaacaaccatgaacagtacac

SEQ ID NO: 1648 - DNA, 351 bp, Melon necrotic spot virus
  strain SCM43651 hypothetical protein 1,1
aacaaactaatcctcggggaagaagtaaagaacgtggtgacagcgggggaaaacaaaagaactcaatggggcgaaagatagccaatgacgctatcgctgaatcgaagcaaggagttatgggtgctagcacatacattgctgataaaattaaggtgaccattaactttaatttttagtgtatggcctgttaccgttgtgactccagccccggggattactccggagcattgcttatattatttatctcatttgttttcttttatattacctcgcttagcccgcaaggaaatacttacgttcatcacttcgataattcttccgtcaaaacacaatacgttggcatctctacaa

SEQ ID NO: 1649 - DNA, 351 bp, Caledonia beadlet anemone dicistro-like virus 2
  isolate I38,2
aacaagttaagatgtgatcttcaaaattgaaataattttctcaggctaaattcattttgtatgctatcttaactcttggtgttacctatttaggtttacttccaggatgcaccgaggcagcccctcataaatccaggaaccctgagtgcttgatatttgtttaggtagacgatatcgataagaaatttacctgctgactttcaaaaaacaaactcaaactcaaatccagaaattgctaattctagcatctcgactgaacaacaagaaattgtacatttcgcaagcgaaggagttactcccacgactagcgcagtccctgatattgttaatctttcaacagattatttggat

SEQ ID NO: 1650 - DNA, 351 bp, Renmark bee virus 3
  isolate SA-4 nonstructural polyprotein and2
tgcactcctcaccacttgggcttaactcacaagtccttgcttcggcagaaaccaaaagagagtaaatatatgtagtcactgtgcgtaatgcgtttaattgtttgtcgcttcatgttgcgtaagaatggatgtatatttgttaatccgccagggcgatccctaaagtctcttttcagagaaaggttcggctgattcctagagtgcgtaaacaactcgctcccttatagttgtaaaggagggttttaaaaatcaactgcccaaaatcaaaataatccaaattggcgagatgagttccaagatctcctcgacctctcaaatgaaaaacttggcaaattagtgcgggatacgtgg

SEQ ID NO: 1651 - DNA, 351 bp, Beihai picorna-like virus 5
  strain BHNXC41415 hypothetical protein2
aaggtccctctctccggttgactcctggaggtgcttgtatatattaagctaaagagtcatgtgtatatatggttacggccactgcatgttattttgtgtcttgttgactgcttgtggaacgctttgtacataaggaattgatgggtatttacccatggtctcgccaaccaaccacaacgcaccgtgcatttatggagttaatacgctcctatgtaacgttttaaatgtattactacgcttgaaaataataacaatgtaaattcatatactttaactgtagataatcataaagagtcgatcgttgcgttccatcacgctgatgccgcctggactacgaaggtggattctatt

SEQ ID NO: 1652 - DNA, 352 bp, Picornavirales Q_sR_OV_036
  putative non-structural protein1
gaattttggaagtaagatcgattttaaactttgtagcctccgcaaagcaaaataagagaagtacccacttgttgcaaccgcaagttgaaataagagtagccatttttgtagcataccgcaaattgaaataagagtagccttttctcaaatacttatttaaaccataaagattgacaaatataaaggattgctgatactgttgtatctataccttcctcaaataacactcctattgtcttcaattgccctcctgaatacgttgagagttttcgctcaattcttttcgtaattagattacctataaccattcttagagttatcaagagatcaatagacgaaatactcgctgaat

SEQ ID NO: 1653 - DNA, 353 bp, Solenopsis invicta virus 7
  isolate Formosa, complete genome.2
atcttccgtatgatccctcacatgacggaagaatccatagcaacggtaacgttgttggaggaattcttgagggcgctggaaaaggaatcgagaaagagaaggagcaagagtggacacgagaagagcgcaaacaacatgagcagtggcagtctggagagtcatctaaagaacgtggatggcgctctggagaaaacgccgctgatcggcgctctcgtgagagagagaatgaacttgatcgtcaatggcgcaaatggcaatctgaatatgaaaatggacagatagccgagcgccagagacaaaatcaaggatggcaatccggcgagaaccaaaaaggaagggagtgggaatctcga

SEQ ID NO: 1654 - DNA, 354 bp, Sanxia picorna-like virus 1
  strain SXXX37713 hypothetical protein 12
caaagcaacatggataccaatgtgtaggaagcattaggcttatagctttgtttaataccggcatcccaaagccaatcttaagataaaaatgagtgtattatcttattatatacaacacttactaattttttaaatttatatttatcagagctgggatatgtttcccagtattgcagaaatgcaattattatagaacataatggtgtttttaattatagtaaatttgtggagcaatccgggaatttaatatctttaaatacaccattagatacaaacgtgcagcaattcacgctaggcgcccctataaacagtacggaagtaccgggagaatcggatgagacttttcacattgct

SEQ ID NO: 1655 - DNA, 354 bp, Wenling picorna-like virus 5
  strain WLJQ102796 hypothetical protein2
gattacatgttttgtgatttatgtgtttgtttaagtgttagtttatgtgttttacgcaccatggctaggggtcacaacaatgggattagagttgtgtcagcagagcccggtccatgagtgtaagcaaccagggttactttggccctatactagtgttcgggttgttaaatataggatactagatcccgagtccttttttaagagtaactcgccttactacgggactttaatgaatgagttgccgatcatcataaaactaaggaggattattaccacgacaatgtgcaagaaacttaccgtttcttgaacaacaatcaaacaacggaagcgacgcgcttagaagtacagacaccc

SEQ ID NO: 1656 - DNA, 355 bp, Culex Bunyavirus 1
  strain CBunV1/Kern, complete genome.1
agacagagtcttccatggtcttactttggcgccttgagatacttttaccttttcataggcactttaatagttgtaccactgcttgtaatggtgtataaggcaataaaaagtttgctcaacttcatgttcaaaaggaaaagagttagggcctgtcatccaaagaaagtttaggctagataactaggtgcgtggcttgattaacacaaagcagccttgagttgataagagtttaattttgatagacaaaggtgaaaactgaattattggtttctatcaaaattactttctttgcttcaaggtggggctgggaattttccctcctcctgtaaaacccttaaaggccaaagaaaacgcc

SEQ ID NO: 1657 - DNA, 356 bp, Picornavirales sp.
  isolate tou80rnanc1 genomic sequence.1
cgctaaacaagttttccgtgcgttcgactaaacgtcggctgggtggacctattaacgataagatcggcgctcatgtgctgattactgataatctcccggataaattaccacttaagtattttgatggtattaatctctcaggaaagaacatccctgggaagtattcatatattaaggtacctacgcgtgcgaatccagagatagctgaccaagagaaagactcacctgaagcattgaaacatcaagatgcgggcggacctgaccagacaactgtcgaccaatcagcacaatcagcaataacaactcagagagatgagtcagcacatgaagtccccgtagttaataaggattctggc

SEQ ID NO: 1658 - DNA, 356 bp, Picornavirales sp.
  isolate ybw202shi06 genomic sequence.2
tcctttcatttaaaactcattaatttcattatggctcaatggaggatgtgaatctctcatatatggccgcacgtaccatatatgttagataagcactatgaacttagtgttttagatcatcttcacttgtataattattttattatactaaatttgagtcatgttagatttgttgaattatcaaaatagtaaatgtagtgtattctctccaaaggagaactttagtgctatttctttgtaatatccatttattctaggaaagttccgaaagaattgtaacaatagatatacagagtgttttgatatgaaaacaaatttgacaaccccttgtaaccaacagtattattttaggcttt

SEQ ID NO: 1659 - DNA, 357 bp, Eimeria brunetti RNA virus 1
  complete genome.1
tgaatgaaaagcgcgagcgcggcgtcgtgtcgaccgcttttctgatcctgctggttgctggaccaatacccatcagtagcaggcagggggagtgcctcgagtcacagttaacgtcggctgtgtcacgacggtcagctcctagtaaattgcataggagttcaccctgtgtattcgccctgcggggtggtacactggaaccacggtcccttagcccagggatagcgccgtggggggatcgcatgagggcgtagttagggttctgctattcagacgtacgcacattaagtgtagtaggccgtcatgtggtggtaagcctaccgctggtaccggggtacagcgcctacgacctacaagctc

SEQ ID NO: 1660 - DNA, 357 bp, Unknown
  Description of Unknown: Hepatitis E virus ORF1, ORF2, ORF3,complete cds's;1
tcttttgatgccagtcagagcactatggccgccggccctttcagtctcacctatgccgcctctgctgctgggctggaggtgcgctatgtcgctgccgggcttgaccaccgggcggtttttgcccccggcgtttcaccccggtcagcccctggcgaggtcaccgccttttgttctgccctatacaggtttaatcgcgaggcccagcgcctttcgctcaccggtaatttttggttccatcctgaggggctccttggcccctttgccccgttttcccccgggcatgtttgggagtcggctaatccattctgtggagagagcacactttacacccgcacttggtcggaggttgatgctgtt

SEQ ID NO: 1661 - DNA, 357 bp, Apis rhabdovirus 1
  strain Apis/USA/A, complete genome.2
tccaccctgatctccgaaactccccaagtcagcagccggacatcaaagcaaccagagcaaccccaaaccactcagaaccaacctcactataaaaaatacatatcttttctttctcaacaataacttaagctccgcagctctcaatctctcaaccagaagaagcagctccatctgaccctagtcaacacactccgatttagcaatcaactacacccaaactcaaacaccccgttcaaacagtcctgcaaccgctgcacgcaccaccggaacacatagataggtgcatacttctgcactttagaaaggttaaaaacgctccaagtcaaagaagtcccttaaaacttaatagaagccaaa

SEQ ID NO: 1662 - DNA, 357 bp, Hubei picorna-like virus 81
  strain CJLX25805 hypothetical protein 11
tgtagggcatcatttcggattgtgggttgatgtcctgggcaacggaagccttgagatggtacgaagcatttttggaacatatgaaccctgacatggtgatattgtcgtttgacttcggttaggaccctcatgcggaccagtgaagaaaattcctattggaatgtcctgtacgcccgtctgagaccgtttaccgtggaatgaaagcgaagacttatcatgtaaagattgtgtggaaagaatttgtgggtaacatggttcattagagctccttataaaaaacaaaatgggtttcgacttcccaaacaaaaacataagaaaaataaaatgtagtgtaattagtaatttgcccctaaagag

SEQ ID NO: 1663 - DNA, 357 bp, Picornavirales sp.
  isolate H4_Bulk_46_scaffold_10 hypothetical1R
ggccggccgggtagccacaagctacccgacccatgctttaggagtcctttaggtgtattgtatatattaaacttcttgtatattattgtacttatattcgggacggtgatgtcccactcttgtcaacaggcgttgagagaactccattgcggcgttccttgcactgtgaggctgcagactgcacattgcgttgatctttctgtagtagcaaggttactggatgtagtgccagttggaggaaatacctttctagcgtccctaggaaatgttcccccctgggcccaatttggcccgagtctgataggtaattcagaccccttctcgtgtttgagcgtcacgcgagaattcagggaacag

SEQ ID NO: 1664 - DNA, 357 bp, Solenopsis invicta virus 5
  isolate formosa, complete genome.2
atgtgatattcaagaggcattctttcatggtcacccatcacataaggaaatttccaataaacttgtgtgtaaggcttgaaagaatggtcggagtactctatttagagtgaggagctccgctggcagccccagcaaatcctctattggataggaacagctatatcgggtagctatagcagtcgtacagtaacatgtgcggcgttccgaaataccatacctggcgattcaaacaaagaaaacaatactaccaacgtacataacacggagctcgcgtcgagttcccaagaaaacagtgtcgaaacggaacagattacaacctttcatgatgtggaaactccaaataggatcgataccccc

SEQ ID NO: 1665 - DNA, 357 bp, Gamboa mosquito virus
  strain GW polyprotein gene, complete cds.1
cagctctagcggtctgttattttgtttaaactttttgtttgcaaactagactttgtcgaaccccttgcttacaaaccattaaacaatttatatctcacttactgcccatattagagttagcactttgttaacttacaaagttaaatagacagttgtctatcgcttcgcaaggagcactcaccctctccctcaatcactactaagtgtgcgagagagatccaaatttttaacatttttataacttggttttgtttcatcagtctcacaatattttctgtccgacaaatccaagttattcaaatttataagtttttaaatttttatttttggaaagttgtctgacttcccccggaagcc

SEQ ID NO: 1666 - DNA, 357 bp, Beihai picorna-like virus 120
  strain BHSC167783 hypothetical1
cagggatcgaaaccctgtatatatcttagagagtttagcagtcgcgcattgtaaccaagacgggccggccctcaccaacacgtagtgattctgcggtttggtgttcggtgcagtgtaagtccctacccttgtttatcttgtgatcagagtgtaagtctactcgaccaaagaactcggtttttacataagtttctattccgaatccaaagaaactcaggagtgatcgggctccacgtacagttgcgacactgtgcgtggcgtcgtcaggtagtgtaccttgaaggttatcctagaataatttgcaaatttaggacatttgcacgtctcccaggacgttaaacggttcgaaaagacagt

SEQ ID NO: 1667 - DNA, 357 bp, Changjiang tombus-like virus 5
  strain CJLX42586 hypothetical2
gggtgcctagcgaaggtgtcgggtgtggagacaaacacccccattggtcatgtggagatcgatggtgacgttttgagatggcgtcagacaaataagctggggaggtcaaaagtgcgtgggttgtggacggtgactggcgccgggttccacaacagatatggcgtgcacaatgcgagtaaagccaacttgctgcgaggtgtttatgagagggtgctctaccgtgtggtaggtggagtagcacgcctccctccaagaccctcgggggatgtgttcaatgaacgcttgtccaagtttcgctctgccttggtggcggaaatccctgaaagtctccccataacgcgtgcccactttgtggac

SEQ ID NO: 1668 - DNA, 358 bp, Mapuera virus
  complete genome.2
taatcagacatgatcatatgccttgcaacagctgtctgctattctaaaagtttcagtaaccaccgatccaattaactggcacccatttaatccatctatttgcctttcttgactcccagctgcacactcctccgggcaactctgccatcttctggcttctatagactcacgatctgcaatccggcccccgccttcctgcatctggcattccaaagtgaggctcgatctcagcatttagaaaaaaccatataggcccgactggcaccacccacccccccgacccaaccgccagccgggaacacaaccccacaccccacagcaagcccacacccgcccaccagcggagacccagcggaga

SEQ ID NO: 1669 - DNA, 358 bp, Darwin bee virus 1
  isolate NT-5 nonstructural polyprotein gene,1
acgtgattatgtgatcttgctatactgaataaataagtgatgtaaaattagtatagtattgctataatcataagaaggtggactatttagtcttacttccaggatgccttgaaagcagccctttcgaaatccaggaaccatcactcgattatacgtcataagtgtcgcgtataatttaaaaactgcacttgccgaaacgaatacgaacgaaaaccctggtacaggtttaaatgttaccaacgatgatgattcgagatataacgaggtaaaacaagttatatcttttaataatcaaggccagacagttgctgatgatgctctagctaaacaaaaagatttgcctcagtcttatttagat

SEQ ID NO: 1670 - DNA, 359 bp, Blueberry necrotic ring blotch virus
  segment RNA4, complete1
cacaaatctgaaccactcacgctggtttgtcacctgtattattcaggtttactaccttcactacttcttcactaccatgcgcttaattgcgtgactacatgcgcttcggcgtgactagcgcttcgtgcgccttccactactgtattatgtaatatatccgtttctttcttcctcagtcaattgtgtcggattgtgattattaccaatcaaaaagcgcggttcctactacttcaccgtgtgttattggtactttttggttaataattacattctgatcaattgacactccctaaaatccaaattctttccctaaaatccaaaagtgagtgctattatacgtattagtactttataatatt

SEQ ID NO: 1671 - DNA, 359 bp, Picornavirales sp.
  isolate bfb201hbp01 genomic sequence.1
tgaatactgcagttaatacagctaggccgacgtgaagtatcataggcggagaagggaaaatccggttatgtaacgtcgttaatataaactcgtgcgttgtgtgtttggcgacatactcaacttaaaacaatgttctttggatggagttcagctaacccctgttaatttcatcgttctggagtagtttaaagtagtgaagacgagtgtatgtgaggattccagcgatggatgaaagtaaggctcccgaaaggtgcaacctcatatgtctcgttgtagtagcgaaatttatgaaactcaaggaatggaccgttgggtaaaaacactcaaaactctctcttttcttatttggtacactacat

SEQ ID NO: 1672 - DNA, 359 bp, Guangxi changeable lizard picornavirus 2
  strain GXSXC1285591
cacaaattaccttttccccctctactgattggttcactcgttatgactaggactggatgtttacgttacggaatttgcgatttcactgagtttggccagctcggaatggcaattttggcgaatgtgggttattgtgaaacgcaccgaatatactcccgaaaggaggttagtaggggcgtgtagcaccacatagctgagaccacatgcgacagagcagataggagccaggaaatacgcctcatttgttgacaagtgtaccggctctgaatgtgtggggaggggtccccacatgggttctgtactgcctgatagggttgcggctgatcagttgcaatgtggtataatcagttggaattcac

SEQ ID NO: 1673 - DNA, 359 bp, Hubei picorna-like virus 1
  strain WHSF7464 hypothetical protein 12
gtggggcacacagtagttatagtagttatatgccggacccggctggggggccctgtcactccttgacaggcagtgaacgtcactggcttatgcaaaatagcggatgcctgttggaaacatgggctgaaaacacaagaaccaacttagtattggataccactttgtatataattatgaatatactgtatatatacaagtaggcttgctaagtttagacacgtccctcgtggcgatgccatttttatggttgtatggtcgtacattccagtatattcctttctgtggtgataatcatatatcatagggagtagaacttgattgctacaaattcaaattcacagagtagcccactctataac

SEQ ID NO: 1674 - DNA, 360 bp, Firefly squid flavivirus
  isolate Wat_scin_armtip_sample_41
gttgacagctgcacaatacaattcctaccttgaaggtacgcgtgttctcggacacaaggcgtgcaagtggaccttcggtctgcgaaccccaaagcgttcaaaaacgttcacatcgttccgatctgctgtacaattcgctcttccgtatctaccactctattgatttagtatcactccttgctgttagcctttcaagaaatttagatttactcttacctctttgcacctccactgctccgcagttgtaggtgcactctctcaattcgtagttccgtcttccctaaagatattctacccgcggctcgtttacacctcgtaaaccccgttacgctccttgccacctccctcaaagaggcagtt

SEQ ID NO: 1675 - DNA, 360 bp, Sanxia picorna-like virus 2
  strain SXXX37883 hypothetical protein 12
catactgccatagcggaggaaggttgcgcgtgagatatattggatacttatggtttaatagcttgtatctcacaatttattggtggaattaaccatttcatcaaccagtatcatataatgagtgtaatatgatacttaaacgcacttactaatttaaatatttacacatcagagtgggagtatgttctcccacatgcgcataacagcattaatcaagatagtatactatatgcaagtatatcatgtatatcagagcattcatcggtagaatttaatgatacaaaagtcgaggatacgaatgtgttgcgttacgcattgggagaaaccagttataaaactgaggttcctggtaatcgtgac

SEQ ID NO: 1676 - DNA, 360 bp, Beihai levi-like virus 15
  strain HOU158632 hypothetical protein1
ccttgggggtcatctggcaatgccagggttcggatctgtagaaatacagactatggtaatccataggaaattaatctccggagtctgtctggatactgctgagacagatatgtcttaagtaggttaagtgtgctttgccagcacacgtgtcattgtgtgatatacgtgtatagtaacgttggctaacgttaccgtgctagttgttatatgatggcgcccgtgccgacacgagtacattctagtagttcagtatgcttagcatgctgttctgctggtctgtacagatgtcatacacacaaccagggctgggagtagtaactaggaccggtccttaacactgtcaaacagacaggaggactt

SEQ ID NO: 1677 - DNA, 361 bp, Changjiang picorna-like virus 8
  strain CJLX30776 hypothetical1
tatagacgtacaacttaaacagttgtcgtactagtatatatttgccgtatcaggtgcgtaaacccgggcggctggcagacgcgaagctccaaacctttagaaaacacaattttaaataaaagttatgtaagatttgtccctatcatttgatcgaactcttaaattagatcatttgagaactccctgtttgtctctattcaaactactatttgagagtagagagattcacatttcttcgttaccctttaacgttaaaagggacattcttaaagcaaatggagtttggcttacgttattgtgcgttaatcttattgctggaattgagctggattgctcttccaagcgtaatgtttgatctacg

SEQ ID NO: 1678 - DNA, 361 bp, Hubei sobemo-like virus 39
  strain mosHB229649 hypothetical protein1
aagaatcaccagcctcggcttcagttatggtggaaaagtcagaccaatccacagagatcttgctccagcaagcgagaataactacatcgctcgagcgtttgatttgtttaatggaatccaagaacttcaaccatatggagtccctgacttcacagaccagtggtccaatacaagggccgaatatagcagcttcttaaggcatgcggaaattagaagtgcgttagaggtccccactattactcaacaacaaaagaacgcactgttgaacatcgctgaggaccgatattctataatcaaacataaaatacaggatgattatcttgatcctgtaaatgtacgggatattatttgtaatttgaat

SEQ ID NO: 1679 - DNA, 362 bp, Sanxia picorna-like virus 7
  strain SXXX37313 hypothetical protein1
ggtagaaggccctgcaaggcctccctctatcttagtgaattgatgagtagatatatgtatgggtgggttgggatacgaatgatccctcccacaacacaccgtaagactacatgttggcacaaacgaccatgcttgcctctgaaacactctgcatgtgatgatgaatcactgttagccaggtggaggttttcaagaagtccgctttgtgttttcacgaatattacgttgagaatccatatgatcgaacacccgcgacaacacatgctcttatgggtacgcattaaaatataacccttctaaaccacattcgtccaaatgtggtccattgacttaggacaaccaaccccccaaaccaacacgcc

SEQ ID NO: 1680 - DNA, 362 bp, Beihai tombus-like virus 1
  strain SCJXSX39078 hypothetical protein1
gatcaaagagttcttcaccggagagaagtcgggaagggtataacaagggagcaatgaagaggaaagtggccattgatgccattgataagaatgatggttcagctattgggtcgatggtgattaacgcagatgaagtaacaatgaccatcaacttcaatttctaatggagtgtcccaaaggattcatgtgtctttaccagaggcccagggaatacgagccatcattcctgattgttttattcattgcagttctgctgttcacttgtacaatccttagtgctacacaacaccaaacaataaacaccgacaactcatctgttaagactcagtacatcggcatttctacaggttcgaaatcttaac

SEQ ID NO: 1681 - DNA, 363 bp, Mount Mabu Lophuromys virus 2
  isolate MOZ135_2, complete genome.4
tgattaaattggataaaagcttagctgcttggttatgagtgatattgtgataaataatgtgatcaattgaagatacttgattactattagtgataaatagattgttgtgtatgtctgtgattactaatgtaactgaattgttgagtttaatcagaccacaaatgctgctatattgccaatgagctattatctcatgactgatgacactatgcgagagattagtcccaacacaattgattgatataatttatttacaatagttctcaaggataattactaagaaaaacttaggcggcaggtcataatccgtcaaaagtttggatgcatgacttctgtctttaagatctgttaaatcatttttta

SEQ ID NO: 1682 - DNA, 363 bp, Botrylloides leachii nidovirus
  strain SRR2729873, complete genome.1
aaatattcatcactattagtatatacgcatacccatacccgagattataatacggtttctattaggtcgttaaacgagaccaaacagaattttcttgtgcttctttagtctatgttactatcgcataaccagattcaacaactatagtagttcctgagaaaaattccgcgaaaacgcgcacagaaacgttataaaaggtgtagtgtatcctattatacccatagttggtatacagatactagtggtgaaacattcacactcgcgacaaaagttttacattttaaaacaaaaagtaaaaacaggctcgttaataaaacaaacgatcccgctcaaaggaagtttgtttagtctcctctaagcagg

SEQ ID NO: 1683 - DNA, 365 bp, Posavirus 1
  isolate Ishi-Ya8/JPN/2015, complete genome.1
ttcccggtgtaaaaagctgggcgcggtctggctcccgtcgggtggaaaggtccaccaatggctggttgagtgtaagctccggtgctctggttgtcgcaattccagacgtcgtaataacctatattgcatctgactctaatatttgtggccctactgtatctagttcttcttctgctcaatctgactctaaaaaacaaaaactacaaaaaactgcttacaaccttgaagaattctttgatcatgatcttcctgatcctatggtctcttatcgttctaaaatttcaacaagaattcttgaaaatcaaggttgcattcactctgattctcatcttactcctcgtgtgttttcattctctactgttggc

SEQ ID NO: 1684 - DNA, 365 bp, Picornavirales sp.
  isolate H4_Rhizo_44_scaffold_11 hypothetical1R
ggacctacacaagcgttaattcgcctgttcgtcccacccctttgcggcgcatgccatcgcgtcgcggagctagctccacaccaactgaggcacacgatgatagttactgctctgaggtcctgagtgaatctgaagagagaatggatcatcatgtttctgcgcctgagcgtccctcaaagtccatttttatggaagtacccggcacaggtataaatacgctcaaggatgggttgggtttcggcgaaccttaccctggtaaacaaccgcctactaaccaaacaacatacatgtcgggagactttaaatcacacacacagattgcactgcaagtgcaatcacaagatgagtatgaggagttgttgcaa

SEQ ID NO: 1685 - DNA, 365 bp, Hubei orthoptera virus 1
  strain ZCM21319 hypothetical protein 1 and2
aacttctggttacccagcttaaaggaaatttccagtaaactttaaagtcaaggctttagttctaggtcgaggtgccctatttagggtgaggagcctcggtggcagccccatcaaatcctctattggataggagcagctacattcaggttgatgtagcagttgttaggtaacactagcagcgttccgaaacatccagacctgcccaatccaacagtacgaacaatggccctaacggcccaacgattgatacgacggacgtcaagatcaacacaacccttgcttcctcttcacaagaaaactcccttaaagaaatcgaaatcacagctttccaggatgtggaagcccccgcgcttgccctcactcca

SEQ ID NO: 1686 - DNA, 365 bp, Wenling toga-like virus
  strain WLJQ101932 hypothetical protein1
tgtggattgcttctggctccgttttgttttgacttcgttaatcgaagcttcggatatttccgagacttgactcaaaccggcgttagacgcgattggctggcgtaaccgttactgaggctagaagggacgcgtcctcgcgatcccttcgtttctcatatttggtgcagctgtacacgtccgttttctcttaagtgtaggtgataggatagggtgagaacgcgggcgccacgttttagctttttctaggacgtccccagtggtttaatacctcggagcttcggctctcgggtccttccccccccgggtggtgtagttagttgggtccccagggttgtttcatcagcgcttcgttgtttttaaaaaca

SEQ ID NO: 1687 - DNA, 365 bp, Hubei reo-like virus 6
  strain WGML611819 hypothetical protein 31
cgccattactactgtaccaagaaaacttcaaacaaacaacaactgcgacaaccctaactaatgtaaccgaaaccaccaatgcactcgaacgcggcaacgcatcgaacgtaaatccgtatctgcactcaacactcaaaaagacaccaattccaaacgatagattaggaacatatatatctggaccacagttaggtgatgcacgcattacaactggtttggtatacccactatcatttcaaaaaatatgggctaaattattttacagtttttacaaagtaaacaacaattcatactacggattagatcgtttcattcatcaattaagtaacggataccttaatgttacaggaacagaagatgatttc

SEQ ID NO: 1688 - DNA, 366 bp, Unknown
  Description of Unknown: capsid protein [Nudaurelia capensis omega virus, Genomic RNA, 24481 sequence
tttctctctcttaccaagtgcggtaaaacaaacaaagaaaggaaatcgagtgacaacggcctctacacacctcacgtccgtgaccaccggattatacgtcgcccgcgcacggcgccttttccgaccactcgtgagagtcgctggacagctgtccgtgaccacccgattgcagtcaaattactgctttcggaccactaagtttgtcctcgaacgacatacattcgttcacacactgtcttagcgagacctaaactcgccttgatagacagctcatgacagatcgttgccggcgcatctgtttcatctacctcctggctattccgttgctattatccctcccgagcaagacggctgggaacttttaga

SEQ ID NO: 1689 - DNA, 366 bp, Wuhan astro-like virus
  strain DSYS3171 hypothetical protein,1
ataacgttgagaacgtgtgtgggaatgcctttcctagactagcttgcttggtaaaaaggtaagacccatgagggtcatatttgattttgttggttccgcttttggaatttggactgttcatgtgtgtacagtgagttcatcgacacatgtttttgaggaacgcctgaattggttttcaggggtgtatcagccccctcatgagtgggtttatcccactctttgggagcttttgcagcgtgtgtgtgatgaactaaatgagcagatcttatggaaccatgatgagggcgacatagacatacaacaagaggtgtgggttgaccctgaggagtttttgaattaggctcttgagttgcggcaagctctcaa

SEQ ID NO: 1690 - DNA, 366 bp, Changjiang tombus-like virus 17
  strain CJLX30686 hypothetical1
gggagcttggtcaaacgaccaataacatgcacaggagttcatagtttagagttgaagcaccacacttggtgtgagtgctcctcgaacaagaattttaagcttcgtgttgttggcctgaccgagctcccttgcgattgcagggggtttaaggaggttgtgcacttaccccttgcaatcaagaattgtagtgagtggttctaccactgcaattgcgtgcacaatatagtcagcgcgttggtgggtcgcgttgctttgtgcgttccgtcacccaccactcatcgaattgagcaactttcaaagatatcacagtctttggctcgatcactggggcatgttctccctattagccaggaccaggttattagg

SEQ ID NO: 1691 - DNA, 366 bp, Ellsworth virus
  isolate Antarctic22 A2 maturation protein and1
gtaacactcaactgtatacccgcgacgcgtacgggtcaacttacgctaacccttcttcaccagactacactgtcaggtttaaaacccaaaaggcagttaaaaccattaacggcatccgagtgacgaacttcgtcacagagatcatcgtcaatgatctggtgggcgttgatgtcaaaggcacgagtgccgttgataacattgccatccgcatacgggtgtcgggagccgctgaggcccatgatcgcgtgaaagcgattctgaaagccttagccacccaacttcccaattggtgcgacgagaacacgttcctcggttttgaaccgaagacgcttccttccgtcgtgagctgataagaggtccaataag

SEQ ID NO: 1692 - DNA, 367 bp, Linepithema humile virus 1
  putative capsid and putative RdRp genes,1R
tttctctggttacccagctcataggaaaatgtcttttaactattgagtcaaggcttagaaattagaatggagggtcctatttaggatgaggtcctccggtggcagccccaccaaaacctccaaagactaggaacagctatatcgggttgctatagcagcatcaaatttatttgatgcgttccgaaacaccaaacctgctgataatcaaacgaacaacgagcaaacttctaccctcacaaatacaggacttagcacgacttcagaagaaaataacatcgaaacggtccaaatcacgacctttcatgatgtggaaactccaaataggtacactaccccgctggtgcagaacactgcagcaactagccgt

SEQ ID NO: 1693 - DNA, 367 bp, Micalovirus SF1
  gp1 and gp2 genes, complete cds.1
gatctccggtctggtgagaccttaaaccaccaatcaggccaatggccttcagcttagcctggcataatcgcactcgaccgtaagctgaacgaaccaaaaccggatgagtgagtgcaactcatctggacgactcatgtaccagcttgacacagctaagtacatgtaaggaaaatgtgtctctaaaaatcaaactcaaaataactatgattttgaacagttatcacaaactgttgaactcacggacattgacaacactaatgttgtgtctgcgcagtccccagaagtggaactctcttctggtgacccttttccagatataactcccacttcctttctctcacgccctgtgaagataggaacccatgtg

SEQ ID NO: 1694 - DNA, 367 bp, Penicillium brevicompactum ssRNA virus 1
  isolate MUT10971
gcccgctgtagctcggcggcattagggagttcagggtttccatatggggatttgtctgtcacacctttgataaagaaacagaatggccgcaccacatgttcgttagtatgtagctcacgcgggttggttacctaaaaccctctgcctagttggatgaaaaccagtaaggcatatatttacaaaaatgaacatctgagtgggatctcagtataactcttccccctgtccgtgggtccacggtcgatggtatgattgggggtgatgcaccatctaaacgcaagtgcagtgcggttcagtctcgcgcggcttgtcagccccccccaacccgggttcagagaccggtcttattctatttagtggtcacaac

SEQ ID NO: 1695 - DNA, 368 bp, Picornavirales sp.
  isolate nut158shi3nc genomic sequence.1
ttttgattactcccgaggtggttagcaacacatttgcaggtgttgttctaaaaaataatgcaaaaagcgaagagaaccttacagcagtggttcaaattcaaaaagaattcttagcagcagctgaattcgaaaacgaagaactcgttacagcagtcgagtgtggaagtggagctagtagcagcagcgctagcagcattgggtttacagaagtgcctgaggaaagtagtgaggaagaagaagaagagcttacagccgtgctcaccgaaaccagtgattttgatgaaatcgaagaaatcatagttggtaaacatcattacaaccaacgcccccgcaattcatatgtcgatgacttgtcctttgtgaacagc

SEQ ID NO: 1696 - DNA, 368 bp, Barley aphid RNA virus 6
  14BaA2 gene for RNA dependent RNA1
cgccgaatagacgtcatgctctacgtttccagatttctggagatgtattgtgctacgcctacgtaggtgcgttcccttcccaactccccctgctcattagagcgggcttgttgggaaaacgccgtagggacatcgattctcgtttgaggctaggcctcaaacgcgatgttctagcggtatccgatttaacaagcaaccgtctcgcggttgcttcgcagatctggtctggtatcattgcatgtaccgccggatctggcttcgtctcccttcgccttgacaaggctcaaggaagagaagctattcatggtctcgcgagactagctttgtggctagtctcgaccattcgaaactctggcgcaactcacgtc

SEQ ID NO: 1697 - DNA, 369 bp, Cryphonectria hypovirus 3
  complete genome.1
gggggttagagaaatcttgggagatttctatcgtcatagacatatgtgatgtacttacgtctctaggacgcctatgactggtttatactctgtcgagttgaacgtctggtggttcctacgtataagaactgcagtcttatgtgtgaaaccctacccctcgctaaccgagaacggttgtgtgatttgaggaacgttcgctgtttaaacttctttggaggaactttaaattgtattaattttgcatttgcaagagttagcccatctctaaaatgaggctatcgctgtgaacagccttaaagaccctctgggcaaactgattatgaattgagagttagacttctcagaaaaagtctggtcttgtcctagatt

SEQ ID NO: 1698 - DNA, 369 bp, Picornavirales sp.
  isolate H4_Rhizo_Litter_21_scaffold_1082R
tgcggtttactggtttatgtttatcattttaaagtattaaacaacgtaatggcttcatcagcaaaaactaacgaacaagctttagggactacagtagcagcacatggcactagtggccaagtgttagctgaaccaagtccaattgatcaacaaattcatgataaccctggtacgattaaggcgtcgactgcaattgaaactcttttcaaccttttgttcaaagattatatttttaaaggattgtataccatctctactgatatggctcccggacaaatcatttggaaattacctattcatccagcagtttgtaatcaatataatgatcacgtaagaaaaatgtttaatgtttggacaggaggaatgaaa

SEQ ID NO: 1699 - DNA, 369 bp, Beihai picorna-like virus 58
  strain BHBei77093 hypothetical protein1
agcctatgtgaaatagttggttttggcttaccaactagcgccactgtaatacgcgccgcacagtcagcttctgtaaataatgtaaatactgtcatcgccgagggtcaacaggttaccccggctgataaagacactaacctgacccacttcgaagatcttaacactggcggagacgccaagatctcggaggtagccattgccagttctggcaagtatactgagtccgctctgggggattggtttaagagacccatccttataagggaatttgtgtggcccgaggacactttgctccttgactcatttgacccttatttgctgtatttctcacatagtacaattaaaccgaaattgcatgggtatagtcga

SEQ ID NO: 1700 - DNA, 370 bp, Karang Sari virus
  strain JKT10701, complete genome.1
actaaagaaaattttgttttctcccataatactactactacaagtatcaaccccgtccgtctgctagagacgctaaactctagcaccaaaaatctagccacatcagttgcttaaagaaccccttgagacactctcccacttaacatcttttaggaatcttcgatgctacaacaacttggctagtaataacagcaaatccatatatttcaacagttataagaggctttatgtccttactttgaaagatttgtttactattgtcacgattactttaattaacagaggctatatttagtgctcagcacgttaacgaaagcatttgtacaatagtatgagtttgttgtaaattgtcttgatacgacaccctatc

SEQ ID NO: 1701 - DNA, 370 bp, Boghill Burn virus
  putative non-structral polyprotein and1
cataagtacctatattcagcgccccggagcatcagttccgaagaatcgataacgattatccagagcattagctacaaaacgccttacaaagtaagaagacacgatacgataacgttgagtgtatgcgaacacaaagagacgaatacttgtggcatttaaagctgataacagctttacgtggcaagattccgcgtgaggagttgagggagataattataaaatatcaagtacattttaaaataaccccatcaatatatagcagtcataataggaatatagttagacctaagttagaagaatactataggatagcatattaggataagttagattataattagtggaactttccacctaatctacctccact

SEQ ID NO: 1702 - DNA, 370 bp, Changjiang polero-like virus 1
  strain CJLX30310 hypothetical1
cgatgggccggtgcttaccccgccaccatccaagtgcccggaggtcacatgcttgacctacgaatgccccaaaccccgggcacttacctcctatcccttcaacgagctgctgcaagccgcttcgcagcgattgtggtcagacgcccagagcgtctgttcccgcttttgcgcgaagggggtagaggcctcagctattttgctgaggcaaattcgagaatgggcctccaagaccgcgtttgcagtcttgagtatactcctgtattgtgtcaccttcgtatgttgggggacgctttatggcccgtggctactcgtctcgacctacccggccgagaccctcaccgcatgcttattggccctttgcgtgcgcttt

SEQ ID NO: 1703 - DNA, 370 bp, Hubei levi-like virus 1
  strain WHWN53257 hypothetical protein1
tccgatctctcgtcgattggcagtacgatgttggagatgtaatctccaattatgcgtccttccaaggcgacggccttgtccttcgttatggctatctgatggacaccacaaggtgggacatcagtgtgtcgacgaagaacccgggtatccggggtcttccgtccacgttcgacgctcactggtggagaatccagaagcgtagaacgcgatcgactccatacggatttggctctaatcctggtgaattctcatcaggtcagtgggccattttggccgctcttggtatgaccaagacgccaagatcgctgcgataactttgtcgctccgatttacaactgaattaacaatttaataaacgaaggacaatgct

SEQ ID NO: 1704 - DNA, 371 bp, Hubei rhabdo-like virus 7
  strain QTM26925 hypothetical protein,1
aaatgaatactaatgtatatcatatgataagtattactacaactcatttcccgaaaattcaggatttttacgagttgaacgtggaatacttcaatttaataagagaaaaatatgatgcatacaagggagataaaaattctcctgaattctttgcatcaatcgacaatcaaaaacttctcttattaattgaagtatgtaactacataaattcaagacatggattattccaggtgccaatattactgttgactccacagtcaacattgaacgcatattggcagaagatcgtaaaaggcgatccaacatccctgcaagatctagttcgattttattcagctaaataatgagaaaaacccgtaagagtcaggaag

SEQ ID NO: 1705 - DNA, 371 bp, Picornavirales N_OV_001
  putative structural protein2
atagttacataaattcatattcctatgccacaaatttaaaacaaaaaattcttgcacggttaagtggctcgtgcctacatatttccaaggagccttgattcttggagtgacccttgaggtccctgcatatagtgtgatggtgtagtataacaaatctggtaataaatatctccaggttttgcttgctgtaaagtacctagtgtctggctcatgcaagcacacgggaatcccgtggttgctatttcttcatattatatgtagcctgtgtaagatcaggtcgattggtggcggtaccaccctaggtgactgagttgtgtcacacctgggaactgaggttaatcagaacaatcttaaactcttatcttttcact

SEQ ID NO: 1706 - DNA, 371 bp, Riiser virus
  isolate Antarctic79 RNA-dependent RNA polymerase and1R
gtaaaactcaacttttatcacgcgatgcatacggcgttacatatgcagatcccaacgaccccgactttactgtgcgcttcaaaaccgcacctaaagcaaagagtcttaatggggctcgcaccactaactatgtcacagaaattatcgtaaacgataatgtggctgtaacagttggtgggcaagcggcggtagatgcagtatcattacgtatacgcacctccggcacccgcgagtctatgccgcgcctgaaggcgatgctgaaaagtgttgcctcccagtgcgaaacatgggctgacgataacgttctattaggttttgaacctcctgtagggaatgaacccgacgttgttgtttaacgggagtaaacgaaa

SEQ ID NO: 1707 - DNA, 372 bp, Menangle virus
  complete genome.3
ctcagaattatctgaacatctacatcaccaacttctaacccaataaatttactgtgtggtcatcctgcaggactcacttgctattgccaccctacaagtaaaagccaattcaacaaatgcattgctttaccgcacatcaactgacctggcacttcaaattcaaggaccccgccacagcgcatgacagcagccccgaggcaaccccctccccacaacccactacacaattcctctcccatcacccaatcccctgctagtttaataaaaaattagagaggtgaaatgcacacacacaacgaccggaaaggagcacgaacaggtgcacccacacaccaccccacagcgaccaacccgccagccatccaaagcatc

SEQ ID NO: 1708 - DNA, 372 bp, Human rubulavirus 2
  complete genome.2
gaaatctatcacaagtctatatatgtccacaattgacccttaagaaccaacttccaacgattatccgttaaatttaagtataatagtttaaaaattaacattaagcctccagataccaatgaatatgaatatatctcttagaaaacctgattattatgtgatagcgtagtacaatttaagaaaaaacctaaaataagcacgaacccttaaggtgtcgtaacgtctcgtgacaccgggttcagttcaaatatcgacctctaacccaatttaacacccattcttatataagaacacagtataatttaatcacaaaagacctcaaaaactgacacagcttgatccactcaacatataattgtaagattaataata

SEQ ID NO: 1709 - DNA, 372 bp, Human parainfluenza virus 1
  complete genome.2
gtctacactcctcaataatgacacccattagctctaaatcgtaccattaatcaaatacagatcaattcgatacaatcagttcaaataagaaaaacgtagggacaaagtcctctaccaacatcaaggaagacaagagtctcaaaaagctcagcctaagcagagagaaaaacaacaacacaaagaaagaaaaggacaagatcacaaacaagaacaaaagcaaaaacaaaaacaagaacaaaaaagggaagaaaaacaaaagtatacacaaaaaccaaaaaagaaaaaaggccagagacaaaaacggaggcaagaacaaaaatttaaacaaaaacagaatttaaattcataataaacaccaagatagagacaaaa

SEQ ID NO: 1710 - DNA, 372 bp, Picornavirales sp.
  isolate H4_Bulk_47_scaffold_38 hypothetical1R
agtttagttttcacatttaaatttgtaaagactgaatttcactctgggagacttgctttctgtttcttcccccaggaaggatacgataatcctaacgcgcctgttccctcttatgcgaattctaattatgttcatagagaaattgtagatattaggttatgtaatgaagttacatttactataccattcatttcctcctcaccatggagacctactgacaacacaagttatgctagtcacaccggatatttatcagtgtatgtagttgaccaactggttgctccatctggagtatctacaacagttactattcttaaagaaatttctgctggaccagattatgaagtagcactgcctaaatcaataaattat

SEQ ID NO: 1711 - DNA, 372 bp, Sanxia tombus-like virus 6
  strain SXSSP2574 hypothetical protein 11
ccctggggcccgcccacgcgcaacaagcaagtgcagctggaggccggcttgtatgcagccctgcgactggaagccgcctttaacaacaggcgaaacggggcactcccactccagctcaaggcaaaggcgattaggcaccttgccgcgtacgacactagcgcttattctccgctagagttgacggatttgatcctcaacacggtcgtagccgccatgcgtcctagtggtcccgaacacctcctagcctcgatgttcggcaaccatcgcttccaaaaggagctcgcccgccttgaccctctttataaactagcttgaagaggccctgctaggcttgacgccacctgcgtgaagggcacccccctggggcccctc

SEQ ID NO: 1712 - DNA, 373 bp, Narnavirus sp.
  isolate H4_Bulk_Litter_23_scaffold_4 hypothetical2R
aaataagacataaggcagttcctatctcaatatctccaaaactaagaaacctacatcaagactcgctccggcaatcaagaagctcaaataccaacgttatattcttcaatcatcaataagcaatcaaacttgtttatccatcatcaagcatcagtaataatgtcaggaataccatctgagtttggaattggtgttgatatgagcaaaacgattgaaaacatgaagaaacttcaaactgccatggaaaacgacccaaattttgatccttcattgttcgatgacaagaaacctgataagaaagtgaagggtaaaggtcctatttccgacttctttcgacaatctggcgactttgttactgaaactcctatgggta

SEQ ID NO: 1713 - DNA, 373 bp, Hubei picorna-like virus 16
  strain SCM51353 hypothetical protein 11
tgaaaataaagcgctcacaattgagaacaaatatttcaaacaaattatattgaaaatttaatttaaaattttattaaaagtcttttaacagaaaggggtattttagtattgaggtattattttacgttgagtaattaaaagcagtataaatctttacttttggctagtagtgctgcggcatattaatcaagagaaagttagatcttgtcatttggtataaaatcgaggttttatattaaaccaatttctagtaaaaatccttacgaggtagttattattaaactaaaaataaattagcaaaatccttctacttgaaaaacactgtgaagtaaggtaaggtaaaacaaaattaaaataaaacaaattatataaa

SEQ ID NO: 1714 - DNA, 374 bp, Marmot picobirnavirus
  strain HT2, complete genome.1
gtaagaacagagaagtgaaggtaacgaagtcaccttcagaacagacaaacggagcctcaaagccgcagcagaagcagcagcggcgttcgagacccacaaagaaatcgttcaaagaaagagcgaaattcaacgttgacagatcacttactgaccagtcagcaacagaagtaagcgaaacactgtctaacaaaccgacatcctcttcggttttcttcccgagccataaggcatctgctctcagtgccgggaattttattgagtccgcaggtcaggaaaactttgttgaagatttttctcgagtaaaagagaaatacagaccaggacacacgttcagtattcgggctaatacacaggcaaagcgtactccaaacgct

SEQ ID NO: 1715 - DNA, 374 bp, Plasmopara viticola lesion associated tobamo-like virus 1
  isolate1
ttgtacttcgaattatctataacttactgaaatttttgttttgttttgttcgttttgttttgatttaatatttgaattatgagaataattttgtcattcgcgattttatgatccaaacttgaccacctgggtgatcacgattcgggtgcagggaatgaaacgctttccagcgcgtgtagttttgaaagtttacttgttgttatgatgtgctggactaaattaataagcacacattgtggtttgtgacggtcaaccataaatactaagattgacctaatgacgtagtcagatggcgaaattaattggtataggttttgagtatctattaggtcaatcatcgcatttcttatacaattttgcttttatttagaatc

SEQ ID NO: 1716 - DNA, 374 bp, Mivirus sp.
  isolate TTP-Pool-7, complete sequence.1
agtgaagcagagcggcacgcgggctcaggaaaaagcgcctggcttccctccacctcgctctcactggaggtagaccaaacatggccctccatgagccaagcagcctattatcaacccgtatatatcatttatgtttgtatatcttatgaggacgggtgccgttatgtactctgaagggccctcactcctccatgacggcctctctattagattttttcgccccgggaacacaggaacgagggcgttcagctattagatgagaagatcatggaggcatgtatccaaaattgtatcctcatctagccctattgtaatcctcttctcagggcaacgtttttctctgtttgtattaaaaaggatgatggaacgataca

SEQ ID NO: 1717 - DNA, 375 bp, Partitiviridae sp.
  isolate H4_Bulk_46_scaffold_395 RNA-dependent2R
caatgcgtatgtcgcccgatggggaaatccgaagaggcggtatatctgcagtatcatgggaactttgttccatgctaatgcacgtgtattctaagattttccggtttgcttggatagtattaatcaatactacttttataacctaagccggatatattaacaaagagagacttatgtcaccttggttcgcatctgctattgtccgtattctaattgcagtcgttgagatcatatcaaaagcgcctttaaaatagaactatgagacgactaattcgacaagtttactattggttgcgttatcgctacccttggtaataattttgattcgttctcctctttgacgtgattacctatttatttaacaaggattataaa

SEQ ID NO: 1718 - DNA, 375 bp, Picornavirales sp.
  isolate H2_Rhizo_Litter_49_scaffold_13612
gaagctgagtccttgacaagacgttaaactgtcgctagatgagtgtgatcttgcaaaactatataaaatccaaagtttcaaaagttttgtattgctgctcatcagttggtagggtcctatttaggattactgctcaaggtcctacgaaggcgtccccttcaatagcctagagcgctttggtacggtctcatttatgggtttatatgagtacttaaattttaacctgcttcaaactctaatattaaagtaggtggggaaactactataaaagcccaaaacagtatgcaagaagacgtcacttctggcaagttatctgatgaagttcaggaaactactgtttttaaaactgacgctaatattgtcaaagcttctatg

SEQ ID NO: 1719 - DNA, 375 bp, Beihai noda-like virus 6
  strain BHWZXX9026 hypothetical protein 11
tttttctgcaactataaagaaattatcgtgacgaccgccgctgttggcggagtcactgccatttgcgtcttagcttataagcgtgaatggtttgtttcaaaggatgccgtttatgctaaaatactcactgtatttagtacgaacgtgcagccggattatagggaaactgttcgccttgttcgctatacgccgctgaaagtgggtggagctcattcacaccccgatgctgcagctgggcgcacaagcgcaaacattttcatcgataaagtgtgtgcgagcataggtcatatcccgttctccctttcgagttcgaatcgtgatgtcagagctggaaatgacggatgccgcaatttttatttcagtaaggatttgacc

SEQ ID NO: 1720 - DNA, 377 bp, Feline morbillivirus
  strain 761U, complete genome.3
gcactgaccatatgatccactgtaataagtccaatgaaagtatcaattaataatattggtagtgcaatgagtattgattgtataatatactcctttaaactagatagtgataaagggttatagatgatttcagttattttaatataatcatatattgattttattatcttacatgactattatgtaattgaattatgtgtcatcaattaatagcttaataatatcgtttaatgtacttatattgatggatagatgtgttatattgtaatcaaggatttagtatttagaaaaggaaagagtttaatttgttgttaattagttattgtgtattcaattagaaaaaacttaggaatccatgttaataaaaatttattatc

SEQ ID NO: 1721 - DNA, 377 bp, Wenzhou picorna-like virus 42
  strain WZFSL74289 hypothetical2
tagcacctaggggaagaactcttttgttcttcctctatgtagtgtagaataatatataccagttataacatgtagactcacatggctagggaacttctacacttgaaatacatcgtggagtctcacgaaaactactgcacattgtggcgttatgtgtggtttttaattttaatgccagtaaatctcgcgataataatgatacaaattcttctctggatagctcattatccaattttaacaatgagcaactttctagctcagaggcagttggctctgacaacaacacgacgacgatcgagagtcatctatcagatattgtactccgcaccatatcgagaacagacccaatttataactcactccccaaaccatatggt

SEQ ID NO: 1722 - DNA, 378 bp, Valsa ceratosperma hypovirus 1
  complete genome.1
gggtgtagagaactcctggggagttcaatcgtaatagacatgtgtgatgtacttacgtctctaggacgcctattactggtttatactctgtcgagtttgctaggatatggtggttctacgtaaagaagctacagttctttatggacacactctaccccactttggacctctttaaaggtcaactttctttaaatttcttatttgttaaccctgatgggtgttcatttctatgcctggagcaacgttaagctggagtgaaaggcccgtgtgcctgaaacgtgagctgataacgagagtcagcgaaagagaaatcccgacgaagggtaaattttagattttaagttggagactgcgacagactgcagacacttggtcaaa

SEQ ID NO: 1723 - DNA, 378 bp, European roller astrovirus
  strain Er/SZAL5/HUN/2011, complete2
caaaacaattttaaaaattcaggactttttggacaatgccggtatggaatatcccatacttacggatgtgaattaccaggccttatggggcttataattatggtaaccaaaatattttatgtgcttaacgtgcgctatactcatgttcggaaaatcagtcaaagacgaagaagaagcaaaaagagtgctaggacaagttttaactgacgaagaaaccttgggactgttcatactatcttgtattgaacagcaagagttagaaacagaagtagtaaataaagaaggagacgaagttgactgttggttggtacccatagtcactgcactaactgcttttatacctctagctcaggatataattagatactttatatcaaa

SEQ ID NO: 1724 - DNA, 378 bp, Barns Ness breadcrumb sponge aquatic picorna-like virus 3
  isolate2
acctgtgatatgtctttaaaagatcagctcagttttaaatctgagttctacggaatagcaaaattaatgtgtgtatttggttaccatgtgattatacatttttatattattattttattgttatataggctttgcacatatgaataaacttaggtttaccctatttagggaggcgtcgttcaccaatgtaaataatgtcacccatagagttgagtcactctttgggattgtaaataccgacttactaattttaaaacacaaaataaaaacaaaaattctttacagaagtccaagaggcttcttcaacgggaaattgatctcaactatcatgttgtttttgataaaggtttcccaaccgtcttccaaattttgacgaat

SEQ ID NO: 1725 - DNA, 378 bp, Hubei picorna-like virus 54
  strain ZCM19837 hypothetical protein1
tcttaaaaacgtatatatagtttcgttaagagtttttacaactcttctcagaaactacgagcttggtttttataaccagctcaaaacgatcagtccggatagacttttcgtctcacacttgtgtttttacagcacaaaatttgtttctcgatttctcaaatcgactaagattttatatcttaggttgcaccgcaaacataaaacggtagttcatttattgaacgaaacagtgttaaagttcacttacaaaactcttaggattttatatcttaaggtcgtcccgacgaacataatcggaaaagtgttaaagttcactcacaaaactcatagaattttatattctgtggtcgtactctcgaacataaagagcgtttcacg

SEQ ID NO: 1726 - DNA, 378 bp, Hubei hepe-like virus 3
  strain WHYY20710 replicase, putative capsid1
aaattggaactatgaatttaataaatacagctgagaagattaagaaattttataataataaattaagttacttatatatcaaattcaggaaaatggagttcccaaaattctatatggatttccagacagcgactcactttaaacctagaggaggcattcaatatttagatgaagcgaaaagagaaatgtattcgatatcttttgatactaaaggggactatgaaacggttagaaaatatcttcagcaaagccaaataaccggagcaagatttgcagcacttttgaaaggacaggaaagaattattggaaatggtcaacccgaaattttaacagataactatcaagctcaatatattaaaatttaaacaaataaataaa

SEQ ID NO: 1727 - DNA, 378 bp, Riboviria sp.
  isolate cfe153shi05 genomic sequence.1
cttaactcggagatgagaggagttgacggcactgcatcgaatttctgatccgtcgtctctggttagcgacgctataggtataaagtccagcactttcttgcatgggactcgtgccacttccatgtgggattcgcccaattcgggcggcactaatctgctaagagctcccttaacggtctgctcttcagcatcgggcatatttattaatgcacgacgggctgaatcgcctaactcccgtagatacacatctccgacccaagaggggctagagaacctgggaactccacagatcttctaggttctctagcccctctttagttagggggagcagcccttgtttttgttctattcttttctcgttcgtataaaataaaaact

SEQ ID NO: 1728 - DNA, 378 bp, Changjiang tombus-like virus 5
  strain CJLX42586 hypothetical1
gacttattaagacacaaggatatccgtacattgtggtcacgaccgggggttgtcaagttcatggcgataaagcttggcgggataccctggcccatttggaggaggtggcaaatcattagtaattagtagattagtgtgcaatacgtttcgctgacggctagaacccgttgcttcggaaagcgcacatcgaacgtggaaaagacaagccacccggcctcacgcagatgcgggttgggcacaccacaatgtaggtacctgcgattcgcaagtgggtgcgcggcggcaaccttcagggcaacctgttgattgcgggacctggcgaggaacgctgactggaggggaaagacctaccaacccaaaagcaaacacacatacaca

SEQ ID NO: 1729 - DNA, 379 bp, Hepacivirus I
  complete genome.1
cagggtttcgaccctggcccggatacctatcgccttacgccgaaaggtaacgagtaggagtcgggtccccaggcccttaccgccaccaagccaggtggggaggtatgggagccggggggtgcagctggtagctccatgggggacgccccgtgagcggatgctgcatcgataccgggttagctctctgggagagcggcacttgacaccacgaatccgggaaccggacaatcgccggcgtgggacgcgttgcctccgtggccgagcaatttggcatgcccgtggtgaagagtgatggtgggggggggccccccttccagtaccgtactgcctgatagggtcttgcctcaagcccagagagtcgaggctgaaaaccgccatc

SEQ ID NO: 1730 - DNA, 379 bp, Beihai picorna-like virus 62
  strain BHBei74566 hypothetical protein1
gtaggggataaccctaccataatatagtgtgatgatttagtcatctctattgattcacgcttgtaaaaagtcgtgttatgcacgacttcccgttgatcgggtttcacagagtttatgactcttaaagaattttctatgcgtgcactgccatagtgtgtatatgtctcccttgttcaacaaatgttggacatgttacaacgtcaggagaggaagaacgtttgccgggttaccacgggagtttgccgacactccgcagtacccaatggctttcgggattagccaaactggcttttcccttttgtaggatgccgtggcgggcctccgattcgcgtgtgtttgattcggcgcacgcgtcttatctcaatggattgcttcactt

SEQ ID NO: 1731 - DNA, 380 bp, Hubei narna-like virus 8
  strain WGML132164 RNA-dependent RNA1
ggagtctgactcacgctggtgagcagtagagcatgttggaagaaacctgaaagccccgttggctgatggtaatggaccgggcgaagtccttaaactcaccattgggtctcacaatataaactacccaaaacggtgaccaatcctgtggcgtcgatcagccgtctgatttcttcggaataagatgtgtagctgaggtcagcaggtcgggtcttaatacttccgtgctaagtgtgttgaacctgtagcggtaaccccccctcctaaagtcggcgaagggtacttcgaaagtttggcactaaatgccgagagactacacgggtaggcggcgcgtgtaggaagacagagaggtctggactggcgatatatgccaggcttcttgg

SEQ ID NO: 1732 - DNA, 381 bp, Guangdong chinese water snake rubivirus
  strain LPSF323051
gaagggggttagaggacgcggcgcgatgatacccctggccatccggctgctcatctgttccgtggccctcgttctgtgtcagctgctgcgtctcacccctgaacagctgcaggcgcttgagaatttcctccaggcgatcggtgtgcccggctgcgtgttggcgctgtttcacaaccgcaccgcatgatctgggccgctctcctcctttggctgctcgcctgtgtgcttagcgccaccgtcgccagagtcacagcggtcctgttcctcgggcttgccgcgctgtacgtgctggcccgaccgtacggatcgcccctctgcaggttgttcgagctcttatgaactccgtctccaatctggtcagcggcctcatcggggtgggaa

SEQ ID NO: 1733 - DNA, 381 bp, Plasmopara viticola lesion associated mononega virus 1
  isolate1R
gtgacagtcaccttaacctcgcaaaatcttagaaaataaatccttctgaaaaactcttgagttcataattatacctaggcttaccggattatgggtgcatggttgatacttttccgcactagtattattcttgaactcgtgcaagtctgtttcgagattactaaagggctggttttatcacaagcagaaaaagaaacgcttaaagaagaacgcaagataatcaaggaaaagatcctcacttcgttgccacctagtataagagattctgctacgcattcgtcttaaggaaaaaccgagttcacaattcaatctattacaaatcactaaagctcatcttaagtgccttatttcctctgtttttcttccctcgtacgtgtcttc

SEQ ID NO: 1734 - DNA, 381 bp, Beihai hermit crab virus 3
  strain BHJJX21702 putative glycoprotein,1
agcacttgagtagacaaatgtcaaaaccaagcgctgaacactttctaagagaaatcatccgtcttgaagcggagtctcgctccatgatggaagattcgtacaaggattctcctgcggtgattttctgtcaacagcactttggtcctggtcggggtctttgcgcctgtgtattcctacgggtagccggagttcccctcctggactgtgtggccatgggggatgttgagaggtatagccttgaggcacaggagttgatcggaagaccattcgcatggaggagtgattgtccaaggtgtggaagggagtaccactgccccagccagtgagtagacccagtaaagatagctgtttaaaaagcattcttatctgatttctctctgc

SEQ ID NO: 1735 - DNA, 382 bp, Riboviria sp.
  isolate war203pic1 genomic sequence.1
ggaaccggctttcctctgattcaagaaagcgcagtgtgtgtaaagcaatagtgcgtgcaagcttacattagatgaattgttagtacctatacgaatgaggcagatattctttgttgggatcatatatggtaacatatacccttcgaaatgcgtctgaacctcaggatcatgtgcggaaaacagattcttttgtaagatcttttactagtgtttttacttttgcaaaattgattaagttcggttttacgacagtttaaagaaatgctagagtttgttataatatttctggagagactttgcggctaaagcaaaagtaagtccagatgactttggtcactttgaagaggaaagtgacaggtgtttttcccctctctttttaact

SEQ ID NO: 1736 - DNA, 383 bp, Picobirnavirus sp.
  hypothetical protein and capsid protein genes,1
gcctcttttgcaatgttagatcgatgtgcttcatcttccatagcctgattatgtctcttcagttcataattggctgcagcactctgtctttcagcttccatattgtgacgctgatcttcggctgctttgaagaaagcaatttggttacttgtcatcattcattcctcctttctgttgatgatgaaagttgtaatcatgtaatttgcgaactagtccacagcaccgaatggctgtcgctagtttacatgaaagtgtggtttttaaactgtgtaaaaccataaagtgttctcctttctgtaaactagcgacagccattcagtgctgtggactagttcgcaaattacatgattacaactttcatcatcaacagaaaggaggaatga

SEQ ID NO: 1737 - DNA, 383 bp, Mud crab dicistrovirus
  complete genome.2
ttagggaccgttgacgacagctccacgtatatgctcattacgcccactgcggaaacaatgtgatgctgtggtgtatacgtggtcaagctagcggcgtgtcccgcttattttagttttagtctatcttaggttaggttaatttagtttgtagttttcttttctccatgtctggttacctatctatcttaactacgctccagacgactaaatttagtatggctttcatggagaggtttgctattcagcgtgcgtgtaccatcggcagccccaaaaacacgcgtcaggagatctccccagccaccatgggctaggttggcagccaggttttaacttggtggggagtaaaatagcctgctccaattcaaaattctgatacttctata

SEQ ID NO: 1738 - DNA, 383 bp, Wenling scaldfish picornavirus 1
  strain XDXMC49056 polyprotein1
cagtactcagtgtatcactgcttactgtgactagatccctagtaaagattttaacacgtaatatttattttgtttatttattatttatgtgtgtaagcgactttgtgctttccacacacaacaaaccattatttagactgctggacgcgtgtagtctcgtgagagttgcgtgaaaatggcttgtcccgagggacgtagttatctggtagtttattaatgcatttgttgtgtgcccatttccttttgtgtgctggaccacggtggtgtaggtgtggtgtgcttaaatgccccacagcgaaccactttaagatttaccacggttttcgtggtattgatcggcacacctgtatttccatggtttgggtacacctaaaggcccacca

SEQ ID NO: 1739 - DNA, 383 bp, Probopyrinella latreuticola Nege-like virus
  strain PlNV1, complete1
taacctatataaaattacaagatgttgatcgtagattacctgagttggtttagcttcgcaatgagcgtagcggatgaacatctggtggtatcgcatatggcgatgattggttttgcggaaaaaccggcgaatcgtagtcggtggtcggagtgtttccaggaacatccctgctacaagcataaccttcgagaaaattgtacccacggccacttgatcgaggctaggttcggcggtgtaatgcactgccggaactgcctaccgcagacgtcggaacaacaggtcgaacatactaaacaacacgacaaatgtcggaaagaagcttacggtatcttggttacagctgccccggaccatagtaagtgcgggtatgcgttcgcttatga

SEQ ID NO: 1740 - DNA, 384 bp, Fusarium graminearum hypovirus 1
  strain FgHv1HN10, complete genome.2
atcactataaacttccatgtgaacgttttactgcagaagaaatacaaaatggacaacagggcccaattcacagaactattgttgctagtgatagggtgagccacgtaccatccaccagtggtggggtattattcttcaggtttttgacgcatggccgttgcactgatcaacgtttcgagttaacgcagatcgagcgggagtgacccgtaatagcaaaagtctatcaccatccatgcgttaagacgtggacgggtgtgaagcttggatgagcgatattgtgccttcatgctctcaggtccacttaattgtgggatgcaattcattttgtaatggtgtttatctcacctgatcatggtacggtcatccgaagactaatttcccctt

SEQ ID NO: 1741 - DNA, 384 bp, Newfield virus
  strain MARplus10845 putative RNA-dependent RNA1
agtcctagtccaccctctctccgttgttatgtttatagtgtccctatacctattttataacacagcccccctgacgaaatttgcaactacccttaacaactctactctcctgaaaccggttggaaccttcatttcatcccatttgacccagacagcgggtctgctatggttggtacccatatcattcgtagcggccaaacctgcctgggcctttctggcggcactcatcactggcatcttcacaactgagtacctccaagctcccacgaaatattgggagtatgcttttttaggagcagcgatggtgctcctactaaaagcgaggaacgtacctcagttcttcatagcattggtcgtggttatactaaccattggcgttgggct

SEQ ID NO: 1742 - DNA, 384 bp, Wenzhou tombus-like virus 10
  strain WZFSL57346 hypothetical protein1
aataactcaacatcttacaatcataacgctgtaggtaatgcggctgatagcggccccattagggtaaactacgcaacacacacaggcaccccaactatcctccacacacctcagacgccgatagaggcagagaagtgtgggcaacggttgggcagaccaatatacgtcttgtcgtatgacgacgagattttgttcaaaacttctctggagcttcacgagctctttgacaatgatctttgcgattttagtatctcaattctcggtgaagacaacgaactagttatcactcgcgtgcacacaaaattagatatatacccagagccagagaagattaccgacattcgacaacagtttgtcgcaagaccccaccaacagaccacacct

SEQ ID NO: 1743 - DNA, 385 bp, Serbia mononega-like virus 1
  complete genome.1
tccgcaaacaacaaaaccaaatcaggtcttagcctttagttgtgagccattgcggtatgacgtactggttttgccagtggacggaagtcgctgagtttttaataaaaccccgtagtctagcgtcaatgtgccatgtgcctatgtgtattgtatcaactaacgtatatgcgtgttataactaatacaaaactacagttttaagaacccagacgagtaattacagaattgaaaggcagtgatagaagagaagaaaataaaggatcgacaacgtgaaaagtacctgtggtgataaactaagcaatacaaaagattgtgaagaaaaaatagtgaaggaatcacagtgctcataaattttcaaagagaaaaagatcaataattactaaag

SEQ ID NO: 1744 - DNA, 386 bp, Magnaporthe oryzae RNA virus
  complete genome.1
gggaaaaacggttgcaacgttttgttccattcgcaggcccagtgttgtcatgggactagttatgcggatggcccacgggtgcgcgcagagcctgtgcgcgttaaaatcgttggagtcacttcgacaccccataggggctcctttggccggttggtggcgttatacactggtgatggggctccgtttcacggagctggacctgtttcgccgttatcaggtggtggtccctcgcgttcctgcatagcgagcctgctcaagcagttgggcaaatcctcgtggttctcaaggtcccgtaaaacaaggaacccgtgcgcagccccgactagaaacacgtaaactgttctacggggggtgctacctacctagtggtttcatagaattttgtg

SEQ ID NO: 1745 - DNA, 387 bp, Picornavirales sp.
  isolate H1_Rhizo_26_FD_scaffold_168 hypothetical2R
caggattatatcgttgaaccattaattaaactgcggtatttcttgaacttattatcatgagaaagtcttttctatactgttttattaactattggaattaagatagttgttgactttgttatgaataaggtggtacctcagatttggaatttcattaagggaattatatcatatatgtttccagatgttaagattaaaaattatgaagaatatgctgaatctcaaagtccaattagagaaacacctggtaagaaaggtggaagaaaagcagtaagattgatacgagcacaagacggaaataatgaatttttaaatcatgctgatagtgtaatgaggcgtaatatgtttagtttccacttgattaaagtggaaacaggaaagacacag

SEQ ID NO: 1746 - DNA, 388 bp, Picobirnavirus sp.
  hypothetical protein and capsid protein genes,1
taacgtaatccaaacccatttgcgtcatatttcttgactcctttcataagtattcgcccttttgatctgaattcgtgagataggtacattgacctaccgtgttgaatcagagaagtagtagcacacttcaatcttttgtaggaagatttaaacctaattttcgaagatgtcaatgcatctccctcctttcggtagttctagtaaatttatatttactagaactaccgaaaggagggagatgcattgacatcttcgaaaattaggtttaaatcttcctacaaaagattgaagtgtgctactacttctctgattcaacacggtaggtcaatgtacctatctcacgaattcagatcaaaagggcgaatacttaagaaaggagtcaagaaat

SEQ ID NO: 1747 - DNA, 388 bp, Aspergillus fumigatus narnavirus 2
  J-YC-2 genomic RNA, segment 3,1
gggcacacgcacccatggtgcattcggtctgctaaacagaccactggcgcaggtcggtgaggacctgcgtaaggcctttaacaaggccagggccgaggcccttaacttggctcagccaagaaccaaggggttcccccttgatcgcctgcgtaggcgattcgcagacactctaggatggagtgtcgtgttccagccgaaggctgtaaaggtcaagaccgaccttgagaacgtcccaaaatgggagccttctccagtgtggagagccgcaccaagaggtgcgatatggagatcttacaagatctcaagtctgctaacaacgatagcagtaagcggttggagagccaactgcacgcacgatctcgtgcgtcttgccataaacacatggcat

SEQ ID NO: 1748 - DNA, 388 bp, Rodent hepacvirus
  isolate RtDs-HCV/IM2014 polyprotein gene, partial1
tacctcctccataggagacacactaccctggcccacgtccgggactgggttgcttcttcccaactttccgggaagagcggcgcgtgtgtggattacatgttcgacgccaatgaagctagaccgtgcgacaccattcttcaggtctcggtgggtctgtaggctaaggcgcaagtgtatgaagcactgtggagtgctatgtgaggggggacccctctggggagaggtcaactcctaccactgacgggggaactcgtcagcttgtcggtaaagcggagtctgtggggataaagctgcacgcgtagacgctaaggcctctgatgcgcggttggtagctccacccagatgaagtgtaacggcgagtagggcatgccctgtgactagggggggg

SEQ ID NO: 1749 - DNA, 388 bp, Beihai picorna-like virus 125
  strain BHZY54174 hypothetical protein1
atatagtatatgtgtattgtctaacaagaatattgctgctcgactatgtcgaggcttattcattggtgttggacgtgcagattttgctagttgttggtggtaccttttcaaacccctatctcagattttctcttggtttagaggacagagatgtctttaaatatgtggtcatgttctggcctactactctcatcatgttttgtgattgggtgattagttaatttgaatggttctggcaaatcgtttgtcagtctcgagatatcgaggctaaataaatatgtttggtctacgagccagttgtgttatcctttaaggaaacaatgtcatcactagggtgaagtacagtgcccttgtgttgattctatttgaactgtcccgtgcgctcagg

SEQ ID NO: 1750 - DNA, 389 bp, Equine hepacivirus JPN3/JAPAN/2013
  gene for polyprotein, complete1
acctccgtgctatgcacggtgcgttgtcagcgttttgcgcttgcatgcgctacacgcgtcgtccaacgcggagggattcttccacattaccatgtgtcactccccctatggagggttccaccccgcccacacggaaataggttaaccatacctatagtacgggtgagcgggtcctcctagggcccccccggcaggtcgagggagctgaaattcgtgaatccgtgagtacacggaaatcgcggcttgaacgtcatacgtgaccttcggagccgaaatttgggcgtgccccacgaaggaaggcgggggcggtgttgggccgccgccccctttatcccacggtctgataggatgcttgcgagggcacctgccggtctcgtagaccataggac

SEQ ID NO: 1751 - DNA, 389 bp, Wenzhou picorna-like virus 14
  strain WZSLuoII97619 hypothetical2
tttccaggaaatgccaagctctgggaacttctagggcgtccgaaacgcgtcctgtttatgttcttttgagcatcaaagccaaagcacagaatttgggactatgtactcggttttagtgaccggattgatagcccagctacctaaacttggaggaatcccaaatattggtagtcatgtggatgacacttggcgaataaaggcatagcaataagtcctactcttagctatctaggttccagaccttgagtcaggcctggttctgaaactaccgacttgcaacaattataaataacgaagacaagtctagtcaagaactagataatccaccagatgtggatgaaagaaccaccacagtccaagctgtaggagacactgaaactgccgaagtt

SEQ ID NO: 1752 - DNA, 389 bp, Hubei toti-like virus 13
  strain QTM25941 hypothetical protein 1 and2
aacggagagatagaatctcatacccggtggatggcagattcccggtcacggccctccaatatcgcatcgcctatgacggctcacatcctgaaatagtggatttgagacctaacgtcgaggttgagggattgaggaggtccgaggaggggtcatccagatgggacttgggttcattctcttcacctatctcatactattatactgcactgtgccgagcgggacaactcaacgtcgcgcattgtcttgaaggaatagtaactacaatccaaaaacagatactgcaaagggcaatcagccccgaattcaaagatgatttcatacgcaaatggtttaaacatgtacacaatttcttttttacaaaaatatccgaaggactgggcaactcccta

SEQ ID NO: 1753 - DNA, 390 bp, Hubei myriapoda virus 5
  strain GCM10499 putative nucleoprotein1
gcgcgaggatagacacccccgttcccagttttcgatcatacagacagatttctgccggtaagattccgaactgagctgtattgccaggtgactgatactactaggtagtatcctttcatttagataccctgaaaaaggtttttttgtttgtttgtttatttggtttttgtttatttgcttctattactttatccaattgtttttcctattaaattttagatttagttcaatttaaatctttgtatatcaattgtttcagtgcattttgttcaaatttgattctgtatcaatccattttcacttctaaacttcttatataaccagtatatcctatacttttgattatatattcatataatattttaaaaaaaccatccagaattgtcaatc

SEQ ID NO: 1754 - DNA, 390 bp, Kummerowia striata marnavirus
  strain pt119-mar-10, complete genome.2
gggtttagaggctgactgtatatatgtaaatagctcggtgaacgtcactagaaaatagcggatgcctgtgggaaccatgggctaaaaacacaagaacccttcttgtattggataccatattttgtacattattaattagactatgtattttatataggcttgcaagaatgtagacacgccgctcgtggtgatgctgtatttacagcttagtcgcaattttgtctgattcctctgcgtagaataatgataactgcgtagttgtaacacctcattgccaacactaacaacaacaacgacggtgccgcgtcttatcaaatcggcacaactagttctaggataaattcaaatactgtaacgtttagggatggacaagagcagtgggatgctgct

SEQ ID NO: 1755 - DNA, 390 bp, Changjiang crawfish virus 7
  strain CJLX29643 hypothetical protein1
gggggaggtgtaggcccccaattatctgacggccgggaaagaccgctggcagcccggaaagacggcacccttaaatgaaaatacaacatatacgataaaccctctatgcgcgccgatggcacccctactttcgattctgctcactgctgctgtgatcactgctatcttcggactcgcttttttgttgcacgcgtgcacttatgagcgaacctacaccaacgacgtatagacatccacagcatttcgtcttatgggtcagtagagctactttcatagtagtataccttgaagttttaaccacttttcaccccggaaggggaatacgcatccagttccgtttccccagactgtacgggccctaccaagtacccaccgctccagcagcgcctg

SEQ ID NO: 1756 - DNA, 391 bp, Amazon lily mild mottle virus
  3a, 3b genes for movement protein,1
cgcatagcataagtgttgagtcaatttgcctttcgataactggtttttggattcattttcgttgttagctcaacgcttgtccgatttccggtgtgtagtgccccagcgtgttggtccacgacattgctccgcacttgttcgattggtactcgaggcctgttactagttgctctgaccctagcttgggtgagtgactttaaggctagctgctaaacccattgatcttgttgagtaaagcgtgagagttaggcccccgtttgtcaaagggctagactagcgcagcttcagatacaaggattgaggtgacatcttgaggccttggccttcaagctctctttgggtggtgtgacttacctgtttcaggtctcgtttataagcaaatcttgtaaat

SEQ ID NO: 1757 - DNA, 392 bp, Fish HDV-like virus
  complete genome
gacatttctctatttcgtcctcaatctcttcctttcttatcagcaatttcttgtattcatctccgagcttcctcctctcttgctcttctttctcctccttggggtcaggttcctctgaatccccaactcttccccgactcttagacctggatctccccccactcttctgcttctctggctctgcagcctctttccgtggaatcttggatttctccctttcgccctgcttagccctcgctagtactttctcagccatttcttggtttcttctcgagattcgggtggggggcggtctcttctggactactctccttgttttctatcaaaagaataactcgagtagagtcctttgaggcgcaccgcatcccgaggtatcgagatagagagtaaga

SEQ ID NO: 1758 - DNA, 392 bp, Marmot picobirnavirus
  clone c206723_g1_i1_libraryC_2746 segment I1
atgaaaggaggtaaaaccattgtttagatggtacaataatttacaaaaatttcaatcattattattttcacaagcaattgaaactatcactgaaatcatgacaggtcagtggtgctttcataagcaagtgaaagaaaaggaggttaacatgacacaaaatcaattaagctatcttgggttggaagaaactaagcgtaataacatagtaactagcgctgaaatcaatagacacaatttagcagatgaaggtattcgtagtgccgcgaatgctgaggctggacgtcacaatttagttactgaacagcagggggctcaatcgttgaaggaaacacagcgatctaatttagtgaaagaagcgatttcacgcgatactctgtctgaaactgctcgac

SEQ ID NO: 1759 - DNA, 392 bp, Wenling thamnaconus septentrionalis picornavirus
  strain LQMMT12081
gtcgaaaccagatttaactctggtgtagacggcatgtccactttcatatttaatttaagttattaacctcattggttgatcaataattataacaacaacttaggttagcgctgtagcaccatcatataatttatgatcggatggtgtgaggctctagcccaaagcactccgtggggctgtcactgcgacacattcccacaagtcaaaacgatagagtacgtagccacgatgcagccgaaaggtatcagcatagcattgctcactgatgtagaattattattccggcacgtggtatgtaggattgggaaatcctaccttagacgtatactccctgataggggcgcggcaggtcgatcgtatagactttaaaacctgttgaaaactctctcaac

SEQ ID NO: 1760 - DNA, 392 bp, Wenzhou picorna-like virus 21
  strain WZSBei23778 hypothetical1
tagctagactggattctagctgtgacatttgatcacttctctttttatataaacttcaggtaataaatgagaagaagctatgtcatgaaagtgggagtccctattcagggagtatgggcctaggatgccttcttaattgatgacgagtcaaataatgatccaggtcccctgaagtcgaagtgtcagtgattgagctgtcaggcactttagattagtagcttactgataacaataataatagttcatctcccggagctgggtccgaggggacaaaagattacacagaaacccagcgttcagcccatgtaaatgaaactgtacaatttcaggagggtggtccaacttacgtcgctgaaattacacatggaaatgatgttactttcgacgatgga

SEQ ID NO: 1761 - DNA, 392 bp, Shahe isopoda virus 4
  strain SHWCII5333 putative glycoprotein gene,1
cccccagtgacctctatcaaatatctgtttagttgatgtctagggctattgagagactcattctgatcactgtgctaggctgccttctcttggaaatctttgactacatacagagaaataacaaggaaagtgaagtgactgttctcgggagaggtgactgtgttatatatacagggaaaaggttttgtgaggaagggaggaagttgagctgccctggtgtctatgaggatttcttctttgtaacaggtatcctgatttcaaaaggtttttcattggctgctattgcaggttctgtagcactgctagcatttgtttacgggaaaataacccgagagttgagaaccagcgaagtgatagacagacgactggacagggaagaagttgtgtaaagt

SEQ ID NO: 1762 - DNA, 393 bp, Beihai hepe-like virus 8
  strain BHZY60925 replicase, hypothetical1
tcgttcttgctgagtgtttgttaaccccagcaagtttcaatcattgaacttttggtgttgttgcaccatttgttcatttcttttccttatggaaaatacaattgctcaggagcgtttgctttctgagtttatttctcttttaaatattcttagtgataaagctaattttgttcatcttgacgaaaggtttcgttgtttagtctgtgtaattcaatacggttctaaggttgatagcaaactttttagtgaatctgttaggtatattaagtatctttgtcataaacatcaaatttgcattgcagttttatccacaggagtttttgctaggtcaaatacacatcccaattgctcttccacagttggttattattgtttccgctgtgatccttcaat

SEQ ID NO: 1763 - DNA, 394 bp, Erysiphales narna-like virus 2
  isolate PM-A_DN17411 ORF2 and1
cctgaatcggaacataaggaaaaggctttcgccttacccatttgtgacggttaaggggcgacgggcactctgtaagagtgacccgcctcgatcgcgatgcgctgttcgtgcctacttcattgcaggctctcgcaggtcaaaacgatcaatccctagtcgtcgaattaatccgtttaccaaacagttatggaaggctgtttggtgtggtcttatctcttgtggtctcggaacacgtgctggttcttgggaattgaggaggtggttggcgcactctgttgagcgcaacggctggctctgtgttgcaaaggagttgaaggacctttgcggttggctgcgagccagggctcttaagagcactggtaagtgggattccaacacacacactcatattccc

SEQ ID NO: 1764 - DNA, 394 bp, Mount Mabu Lophuromys virus 2
  isolate MOZ135_2, complete genome.2
tagtataacaggatctgaccattaagcactccaatcttaatgcaaattaaccttgaaccaacactatcaaagtacgattatatgcattggtggatattaattgactaaccagtctaataattattatattaatctacatagcaagttcaacaaattaattcatgcaattataatcaacacacaaattggtagaaaataaggtcatgattaatgtataggataactgatggcttactgacaaatgaagtacttacgacttcaaatattcagttagaaaaaacttagggtcaaaggcgagtcaagccattaaaacagactttaaagtgtgcattatcaccggtacgataatagaagtaggcttacaatttagctagatcttgttaatgcaattaac

SEQ ID NO: 1765 - DNA, 394 bp, Mawson virus
  isolate Antarctic86 RNA-dependent RNA polymerase and1R
ccatgtctaattacaaaatccgttcaagcggcgaagccaaaactgtgttagtgaacccaacgacatataaaagtacgttggaaataactcataagtttaagcgagataccgcgctcaacgtcgatcaggtccgtattggtgtagcttcggcttataccgataatattaagacctgcaaagacgcatgtggactcgtacgccgtgaggtagtaaatcttgaaatgtccgttcttttgggcatggaagatgaatactacactcgcagaaaacaacagttagcggatacgctagctgcgggccaaaaattgttggaagcattcgacgaggtaaaactcggtctcgtcccgtcaattgaaatcgacgcgacagtctcttaaccttataaggaataatt

SEQ ID NO: 1766 - DNA, 395 bp, Picornavirales sp.
  isolate ltt163shi1 genomic sequence.1
gccacaaaaccatacaatcgttggttcttgtcttaattttgatttttgagcgccagatttcatacagtcgtcagctaataactttgcagcaggtagcagacgagcaataagatcagtatttgcgcgatttaatttaatggcagaccatcatatatgtaatctttgttgaccatgatcttgtttccattaatgattttaaatattcttccgaaattaattcaaaaatttgtttgacacaactagccgattatattggttggttctacaatcatccagaccccgataatttagattacacttctcgctatattgctgaaatcttcgcttcatttatatgttgtaacttgcatttcactaatccactcgcaatttctgagtcagagttctttagtgat

SEQ ID NO: 1767 - DNA, 395 bp, Hubei picorna-like virus 2
  strain WHBL73152 hypothetical protein 12
agaccactgaccttgaaagtcacaaaacttatcacggtgtagtagcatcgtaaagcaactacaatgtttatgtatagttactgtatatatgtgagtttttcatcctttaatttgtaagagtggatacataaataaatcctgcatgggcgttccccgaaatctgtttttacagatgatgttgctggacatcaaaaattgaaatcgcagtgagaaatgggaatattcttagctgttaaataaataaataccttcccggaaatcttttcaaaaccaaacaaaataaaaacgaggagggagtgaaatgctccacacccggttttcgtgcctactctaaggaagaatcacaaaagttcctaaatattctgatcgatgattatatcactagattagaagaa

SEQ ID NO: 1768 - DNA, 395 bp, Hubei tombus-like virus 8
  strain WHCC116238 hypothetical protein 1,1
ctggatagtggccattggcgcttatagggagcgcttagtgtacagtaccctccgccacccgggcattggctacgggtggcggcgtctgcgattgccgaaggacacgatagttcgatttagccgtggctagctgtagtggttggtggtgagtccaggtgagaaagcttggtaaccaatccgaccgcggtgacagtgaaggtgaaatcaaacaggggattccgccaaccccggacgttgtagctaggcccatattagagggtccgacgtagccagattttggatttgttctgtaaacatttccagggagctgtagcggtatactgcagctggtgtgaccgaccataaggcttagatgccgttttaaataaagtcacccctcaatttttcaatccacc

SEQ ID NO: 1769 - DNA, 396 bp, Hubei tombus-like virus 13
  strain WHYY18977 hypothetical protein 11
ggggaactggtcgagcagcctcgagttgcgtcggctggtacggagggagtcgtcccgacactccccctaaaggttgcggtggctgcagacgggtctgcagtcggcgcaccagtggtagtaacgcctgagcaatcaggagccacaaaagcgatccggaggccccggggcggttgcgccgttggtgatgatgttgcggaaaagccgtgtgggtgtagaaggaaagatggcacgccgtatcctttcgagtgtgagacctgttactttgaaagaagtcacagggagagaaagcaagagaccatcaagaaggtgaaggaggcggcgaaggttacgaagaagcataggtgcagcaccaggcattgcatctatcgagacggtgccaggaagagcaggcactgg

SEQ ID NO: 1770 - DNA, 397 bp, Tetranychus urticae-associated picorna-like virus 2
  isolate Lisbon,1
ttcgcagcagatttattgtgtggaggattactatttatttagcgtacctatcacagtgaacctaggattagtagattacgataatatagcgtacctatcaaagaacctatttttataagatgcattttacatattcaatcatatttgcttgcattttaaattcataccttgttccagtagcattcacggttagttgagaaatactggttagtgcgttgtatctacaggcatgcacagaaatcactgtaggggagatcacaaactcgattaacaatgtgcgccgaagcataccggagcgatatctgtatgcgccccccttacgttctaagttacaacctgcccacgagagttaacgatttgtcttttgaatttacaaactacaaattaaactttaaaa

SEQ ID NO: 1771 - DNA, 397 bp, Wenzhou picorna-like virus 19
  strain WZSLuoII97616 hypothetical1
cgggggggtctatacccccccgttatgaagaaaacatctacttacgtctctcactttttgaagtgttattttgcaagtttattgttcttttcgccttttggccaggcttatcacctgatactagaaacgattacacatacaactttccccattacgttacacgtcacaacttatatatattttgcagtcgttattcgaatgcgcttaagattatcggctgtatatatattcggaagaaaagttagtttggcagctgacaccccgttattatgtaacatagagatttatattgacattttatgtattcggggattcatgtgacaggagttgggctcttaattgagtccttcatttgttatattgccaacccttttataccttcctagcgaatagcgat

SEQ ID NO: 1772 - DNA, 398 bp, Borna disease virus 1
  complete genome.2
accgtaccgaccaaactcttaaaaaccctcttctcgggacagaggtctctttctgccttaaatcgagttcactcccccatcacgtacgagcattgggccagattaaagcaaagaacctggcatcctgtgactattacttgctattccgccaagttgtattgccccctgaagtatatcccattggtgtcttaataagagctgcggaggccatactaacagttatagtatcagcttggaagctggatcacatgacaaagaccctatactcctctgtgagatatgcactcaccaatccccgggtccgggcccaacttgagctccacattgcctaccagcgcatagtgggtcaggtctcgtatagccgggaagcagatatagggccaaaaaggcttgggaat

SEQ ID NO: 1773 - DNA, 398 bp, Plasmopara viticola lesion associated yadokari virus 1
  isolate1
tacattctggtttccccaacgatttgcattctgaatttcttcgtttactttataccccccaacagcttgaaaacccggacctcaacgtccgtcgtctcccgcatgtgatccgctcacaccctaagttcgactccgacttaattcttcctcaacagattcccattacttatggatctaaggaaggtcgtacttgggttaatgatcgtcgcgatccttacctgacgccattcgctgttaaaaacaaattagcttttgaattcccccgccccaacggttccacacaactaaaatctttcggccctgaccccttcgtattcgtcggttccaacacgagatacgccacttctgacaagctagcctaccggctacgcacctggcattctcgtcctaacttggac

SEQ ID NO: 1774 - DNA, 399 bp, Dicistroviridae sp.
  isolate rbu035shi1 genomic sequence.2
tcttgctaaactgaaacaaattctcggatataaattagtttagtagtgctatttctcagacaggctgggctatttagtcttacctcccaggatggcctgtggcagccccacaatatccagggtaaccgagtatatgattaagagattaagtcgtcctttttcatgaatatctgacttgcgaataacgatacaaatacgaatcaacaatctcgtattaaaactgatgatgttacttctgctcaagcatctgaactttacgagattgctcctgaaatttcaaattcagcagagcagcgtgtgcagatcacagcatttgctgatgattctgcagttttagccgaacatgtccctggtgaggctattttacctaatagggacacgacccagcatacagatagc

SEQ ID NO: 1775 - DNA, 399 bp, Hubei picorna-like virus 23
  strain spider70066 hypothetical protein1
atgtaaacaacatgtatacaatttcttgcaagactacagttggtagtacgttacaagtatttactgacttcggagtttcaaaaagatgatatgcaaaagcgtaagtgattctcgagacgatgatgaacgaaaacaacttagtcaaaaagatctgaaacccagaaattagatttaaggcgcacattaaatagtaccaactcagaaatgagagagatgatttatatacgtgcaaaattgaaaatggaattgtagaacggatttgaacaaccgcatgttagacatgtattatggcggtggaagatacagtataattaattatcactatggattaatagaactgtatatgcctggcctccgaaaggtgattgcaggcaatccgtgagggattaaaactcatca

SEQ ID NO: 1776 - DNA, 399 bp, Beihai bunya-like virus 1
  strain BHTSS17606 RNA-dependent RNA1
gccaaacaaaacccccgattacaagaacaatcgacctatctttataaccatatcgctttatatcacacagatctaaataatttggctagatgtaatactcttaacaggactgtaataagagaagaatggatctctcagtcagcaggagaactaaggaatctacctccaattactgttagtctattaacagaaagaagggcattgattaatattgagacagaaagtccagaagctaagggatctagtttgggaactgagagcacaaaccatataattggagatgagcaattaagaacctttgcccatgatttcacgttcaaaatactatctgagaagacggatgttcctcttatcaagttttttgaagcatctggacctggtgataatttaacaccagat

SEQ ID NO: 1777 - DNA, 399 bp, Beihai bunya-like virus 2
  strain BHZC35426 RNA-dependent RNA1
cctgagtcatcccaaggggggtatgtgtacattaaggatgtcaacaaatcctttttaaatgccctaacaactgaccgccccaactcaatacctagcttggatttggaatatgattatgtcgttcgtattcaacatgatcctagatctcacatcgacttgtctttcaaacctacagagcagtttgtgattgtcaatgtaaagaagagtggttccatttactttgaggatcacaagtattgtctttcaggccattctattaggaagtttccccatgattttactctccgtctcttgagtgttttgcctgagagacacatttatgaattctttcctgatttaaaatcttctcttaatgagcttagtcctgacattgttttttggtggcaggatgttttctac

SEQ ID NO: 1778 - DNA, 400 bp, Schistocephalus solidus jingchuvirus
  isolate SsJV-SsAE segment L,1
gaccccttggggacaaagatccacacaccacacactatttacctacttaactaactaccaaagcattgcctgggctttttcacaggtgtgttctcgaggttgggatttaactgggataatgtgttgactaagatgtatcctgaagaggggggataatacactatctccagtaagaaataagaggctcgacgtataccctaacaattaacatctgaacgtataccattacatcgtgacagataatcctggatgaattaacctggaaactgtatgagatatcctttgaactacccgagggagaaattaagagactcgatgtacaaaggacagttccgagggctgaattttcagaccccaaaaggtgagaaaaacatctcacaatctttaaaaactgtttgct

SEQ ID NO: 1779 - DNA, 400 bp, Guangxi houndshark hepacivirus
  strain NHJSG30635 polyprotein gene,1
catcgtgctggccttacggccggggttcgccccacgtaggtcactatgtgaccacagcgcggaagcgcacgtcaccttaacctattggtaaggcgattcactaccctctagcagctagctgcactcggaccagattctgtatccgacactacataagactagcgtacctagggctaacgtctaacgtctcaggtacggggccagtccgccggttagctcacgcgccggctgatcatgcccttaatcctgctctgctagggttagaggtgaaaaaacattgtgcaagtgaagctatgaaaccatccgtcgtcgagtgggcttgggcccccactttaacggacgatgctacagcctgatagggcgttgccactaccttgcactcttaagtggttgtaacaca

SEQ ID NO: 1780 - DNA, 400 bp, Vespa velutina associated ifla-like virus
  isolate VVAILV/144I,1
gccccttaaaatttaattttaaattggaatatcttttgatactccgactgtttatttggtaaccccaactaggcagtataaatacaaattggaatatctccggatactccgactgtttgaatagtctctatttaagcagtataaaccaaacaaaagcgattaaaataaactttaagtggcagtgtttgacttggtaattttatcactcaaactaggagaaatccgaatcccagaggacgcacttaatagtctaaatgaacaatttttcaataatagaaatcgaatctagcaattttgaaagcgacacgcgaaattttgaaaacaatccatataataataatttaatagaacgttttgaatttgttggtgaaggaagatatcttatagaagaaaatcaaca

SEQ ID NO: 1781 - DNA, 400 bp, Arivirus 1
  isolate A0197177/6176/2010 non-structural polyprotein1
aaacgaacacagagataaatactaataggactacatatagaagtgtaccctattactactcatctgaataataagaataagaatcataagaataagcgaagcacactaggatatatataatacatatatccacgaataagtataagataagtacaagaattcacaatatcacaacagcaattgcaaatccagaacgaaagttcatcacaattcaatacactattaatacataagatacaagaagtaattgatacactatttgaacaagtcgacaacgataagaaattacaatatctaatagataaagtcaattcactatatagattggttaaagattatacggattcacaaacagaaactataatagcatatataaataaagatatcgataataagaatc

SEQ ID NO: 1782 - DNA, 401 bp, Arracacha virus V
  isolate CNPH, complete genome.1
ttagtttcggtagcagtagcaagtatgatcagattaggtatagatcggcatttaataaattagtagtttaaataaagtggcggatagtggagttgtgctgctaaagtctttcctgcgttatcacagatacactaaggaggaattctttctgcttgcagacattaagggagaaagcttggtggattttcacattcgatcgagaggcaccttgagcgttgaggatttaaagaaggtagcgaacgacaatttctcacccgagaatttgagttcgacagtgaataacatcctcaatttcaaaaagctgacctgtgaagagaaggacgttctgctatttattggtccgaggattgtggagatagtgcctcccagatactccagcggtttacactacagcacttacc

SEQ ID NO: 1783 - DNA, 401 bp, Rodent hepacivirus
  isolate 05VZ-14-119 polyprotein gene, complete1
cactccccgaggggaatgcgccagccctggccttgttggacagggtagcgagagggtcactccatttttctttacctctcgccactgggctggtcaatggcacagacgtgggacgctataagcctccgtggtctggttggctgtagtctggccggtctagtgggcccccttggaatgataacctggaagagggctaacgtgaactacccggacggaactccggggcttgggattgagcgcaccagtagacgcttcggcctctgatgctgggttggtagccgcctttatggtacccaagttgggcatgcccataggaatcggggaaggcgttgggttgcctcctgcctactgcctgatagggtcgtgccgtgcgtccaggttcttacggctgtataacactt

SEQ ID NO: 1784 - DNA, 401 bp, Beihai picorna-like virus 80
  strain BHZC36213 hypothetical protein2
agaggtcttttacgtttcgaacaaagacaatgtctgcaagatgattaaagagctttctttgcatcctaagtcgacctttgatgaacattgtccgaagattttacgcgcttgtagagaaaatttgggttttattccgtacccgaatacgtatgatgagtgtcagagagacatcttgtcatccggaatctgttgggaatgatggtcgtaatcgactacaattggagtgaatttaacgtcagcactaaaagatgccttgaatatgctgagggacactcccaggtgggctatttagccttacttatcaacttacctgagcagcagtcctgctaaaaagttaggcaaacaaaaccaactcttagggattaagtggtccctaagttttaaacacacttgctgaaact

SEQ ID NO: 1785 - DNA, 402 bp, Rudphi virus 5
  replicative protein and structural protein genes,2
gtgtgcaggagctgtcactgtggagacaataaatccaccccagttttaaatctgatggcagcaaaattaatgtgtgtgtatggataccacgagtacaatatctttatatgttttgtaaacttactcgtaggcttcgcatgcagcaagggtccctaatggggaacgaaagtgagtcctccctgctcaaacggaaacatgtcgttccacatcgcttaatccagcgtgtggtctgtacataaaaggattggtaattgtaaaaccaaaattctcggcttaataaaccgacgtgaaagttgtccacccaagaagggtcacgaaagagacaacacagaagccggcgtcagctggcaagactggaatttcaaaacccagtcaggagttgaacaaaatgatgcctacatc

SEQ ID NO: 1786 - DNA, 402 bp, Hepacivirus E
  isolate RHV-339, complete genome.1
accatctacactccccgttccagggattcccagcgtgctagggtggcacgtatctgctccgtttacattatttgagcagggctggggaactgaatggcaccggtgtggcaccgctattgcgctgcgtgaccgggttggctggagtctcagtctctccatgcgggcctggacggaccacaggggaggggagagagcaactgaaagtgtatccatgagtacatggagcgctgcagcgagcgcacatctaccacgcttcggcctggctaagatggttggtagccgcctatatggtactgcagtagggtatacccgcactggaggggggatagcgttgggtcgctccctgcttactgcctgatagggtcctgccaggggcccctcccttctggctgtaaaccactt

SEQ ID NO: 1787 - DNA, 402 bp, Trichosanthes kirilowii picorna-like virus
  strain pt111-ifl-1-NW1
cagacgttagtaaggcagctctattcattatcatatgaaggtttggatacaagttagctatcgtataggatggaccaacgtatgttcccactccggtcacaacctcaatttcaatgcgaattaatcgcaccatgtggttcggattgtaaccctgcttatgtgtgacagatgaaatagcaaaagccaattcatccacccaagatgttgcaccaacatctaacatgccattacgtatattaacgtatggcgtgcgcgatgtatgcgtgcgactgttagttaatggccccaagcgaccttcgtgatcaatgttgcggtaaataacattgaagcttttaagtctcattggttcgtcagtgattttgtaagaattaactattctgaaatcaaaatcttccaagctac

SEQ ID NO: 1788 - DNA, 402 bp, Hubei unio douglasiae virus 2
  strain WHBL72658 hypothetical protein1
gacagctccacactggaggctatatgctacgggcctgttaaagagccagagctcctccccggatgtagtcacaacgttccagtctgcgagtgcaagtgttcaagagtcacaacaaaactctttgacttcataccagctattccgtcgttggtatggactcataagtcatgtgtttgtaatgaaaaggtagcactttcattgcgtcatcagattgatacaggcgatcgctatgcaaccacattagacttacgttctgtcctgaagccctggatagaacatgttagccccgtttcacctagtgttataattaggcatgctacgtcacgtaagaggctattgttggaacaagctcttgaaagtttgaaaggtgaagaattatcagttaaggacgctaaggttaga

SEQ ID NO: 1789 - DNA, 404 bp, Beihai paphia shell virus 2
  strain YYSZX17625 hypothetical protein2
ctgcaaaataactgtatataatttatttgaggtgtgtaccatgagccagtcacatcttttgtacaaaacggcttactacattgtataggtgcaaggggagcacgaagtcaatatccccctctaaatacttgggtaaaagtacgatttgccaagcggtggatgccgcgaaactaccaaccgttccaaggaaggttaagatagtgcgaactgcatcttttgatgaagtgtgtacagcatacgattcaggagatcctagggagccgatctactattctgcggaatgttctcatggtgatgttttggatgttcagtccggaactgagaaatttggagttactatcaccaaaccagctaaaggtactaaagagcagaatgtatcatttaatgatcaaaatccttctttc

SEQ ID NO: 1790 - DNA, 404 bp, Shahe picorna-like virus 6
  strain SHWC0209c11084 hypothetical1
tggagattgtgctatccacccaatgttaattctgggaaaattgcacatgtataacatagttacttagccctaaattagtcctacatgcacagtagggtgagaggatgttatgcagcgtagcttagttgccattacgttttgcgcgcgttgtatcgtaggttttcgagcaagcttcggtcggcttgtttgataaaatttgaccacctgtttctaatcataatattttgacgtttattgatgataacgtcggggaggtgcatgctgcaccttccattactgatcccacatttcatcgtggtgaggatcatgctgcccccttttctggttggttttctcgacccttgcgtgttgccagttattcttggtctgagggcactcaactggccgagggttttaatccctgg

SEQ ID NO: 1791 - DNA, 404 bp, Hubei toti-like virus 17
  strain tick107859 hypothetical protein 1,1
ggaagttccctccctggggcctcctccccttcctccaatgggttaacattggagggggtggtagggcggaggccgccctgcccgagtactactctagttggccccagttccgtcgggcacttgaggggctgcgggtcaccagtagtaggctactgctcgcgagcagggaggccgaggggaaactcttccagtggcgtagggaaaatggtctcgagtggtctcctgcgtggacgacatctgagggggtgtgggccgggggtgacccgggcccccactccctcggactcgacccccgcggagcccgcgccctctcggcgtgcaagcgcctcccggctaccattggccaggacagcgccgctgccgcccatgacgcgtgggtcttgaggccactcaccaaggatgag

SEQ ID NO: 1792 - DNA, 404 bp, Bruce virus
  isolate Antarctic42 capsid protein gene, partial cds;1R
tttatgactaacattacagttaacagcaaaactttcaaagaagtagctgaatacccagatagaaccgagtattctaactcggcggttgcgactacgtcgccagagtcaatttctattacacaaaagtggaataagaaacctaattcaaaaagatcaactacactgacttgcagaaaagttgtcccatataagaatgagaatggtattgatgttgttgaagttattcaggcatcaattcgtttaactcacctaccaggccgtctggctaatgataaactagagactattcagaatctatttaaagatctcttagctgttgcatctaattctgatgtacaggtatccctagttgctggtgagcataatttgactctttcactttagtaaaacttaaaggatttata

SEQ ID NO: 1793 - DNA, 404 bp, Ousland virus
  isolate Antarctic81 RNA-dependent RNA polymerase1R
ttaaccttcctaggagaaaatccttatgccacaagcaattgagctttatagcaatgcaaccgaagctgccttcgtacaccctgaagacgtcctcactcgtgcgcgtttcacacgcaaactaagtgaaaagactgtcaacgggcttaagactgcaaaccttcggtctgagattatcttaaaccaaacggtcggcctgcgcgtatgcgagcagacctgtgctggtgacgaggtactttccgcccgtgcttcaatatctggttcaatcaagaaccatgagaaggtcgacgcgttagtcgacaatttgattgcagcgttacaacagtggaaaacggataagggtagccgaggcttccctgttaccgacttcacgtttaacgattaacaattaaatcaacggagggtcc

SEQ ID NO: 1794 - DNA, 405 bp, Hubei leech virus 2
  strain SZmix21584 hypothetical protein 1 and1
tggctgcaagtccttttggacttgcagtcagtattgtgtttagttgcgttaaaaataagccatcgtcgtttagacgatgttttgtttgtaattatcacctttttctcggctttaaattgccggcttttgcgaaaatttaccctttctttgctacctacaactttttgtagtacactcccttgtcattttaggagagtatctagcttgatactaagaaaaacgccgtatgtgtctgggacgcgattcggctacctttatggtattgatgacaattttatcttagtttagtaaaactaagcatttcttaatgaccttagaaatgaccaaggccttttatgtacacccagcagtactttatgtgctgggtagtgaagtagcttccacgattggtgctacagttcaacc

SEQ ID NO: 1795 - DNA, 405 bp, Rymill virus
  isolate Antarctic21 RNA-dependent RNA polymerase and1R
tatgacaaataaagccatacttctccaggcaactggatcgaatcgcgtgtacgctcaccccgaagacattacgcgaactgttagccaaaaattacagctaaaagaacgcgtcgtcgacggtaaacgagtaccacatgtgagaacagaggtgatcctcggtaggcaagctccaatcgctgtgtgtgaaaacacctgcgctggttttgaaaacctcagtgtacgtctaagtctgagcggcagtttatctaattctgctgccctagacagtatgttggaggaattaaaatccatcattgaccgtgccaagagtgacaaagtcagcaagggcttcccgttaactgaaattactttcaatagttaaggaaggttaatgtgaacacacaatctcgcgcgcgagcgccgaaa

SEQ ID NO: 1796 - DNA, 406 bp, Aedes aegypti anphevirus
  strain Ab-AAF nucleoprotein (orf1),1
gttgggtgtgtttggggttgtagacgagcgatatctccaagagataagcctaattgcaccgatcagggaagacaatttcacaaattacgagttcacggaggttatctaccgaaagggggcggcctcatacttgttgaacattgggattcacaaggagacagaagaaagggctgtgccgggatacgatcaccaatccctttgcgcggcactcgggaagatctgcccatttaagggggagcgatctatccctaagggtgtatctgatgcatcagttacgatcctgaaccctcaacggattagagaactatcgcaggttcttgctgcattgcccaagataaaactcttcgatgagactggggggatcaacatctctatattgctagcactcctgcgatggattcccggt

SEQ ID NO: 1797 - DNA, 406 bp, Thrips tabaci associated dimarhabdovirus 1
  isolate Tamono1 RNA3R
gtgccagggtggatcaatcagatctgaatgtatcatatgtgtagaagtcagtgaaccctccctagaaccgaattgagtgtttcacattacgtgtcaggatgtgtacagcaccaaacgcacgattagaatagttcaattgttgacgagtcatctcaacacgctactggacttgtgaatgtccctccacttgattgcacaatttttggattttaatctatttttaagactatttttactgggctaacgggtgtgtaatagacgtcttccttgttgactgtctgggttaatgtttgaatctcgcttttaacttttggtattacatatatattaaaggcccttttgcctcatatcaatatctctgaaaaaaactaacagatttaaattgatcttaattgtgaattcagct

SEQ ID NO: 1798 - DNA, 407 bp, Mella virus
  isolate Antarctic59 RNA-dependent RNA polymerase and1R
ggagtatatcctatgcaagcacagaactttagtgtaaccgtgacagacggtgaaaagacctttgaggtcctgtcacctgccggcgcatcagcgcctgcggaattccgtttacaagacgacggagttgcgcctacgctcctcccgtacttatcaatcaaggcaggaaaaacaaatggtacggcaaagcgccgcgccagtattttgtttatcaagccgattgagaaggacgggctgcgtattgggcagaacgtttttcaaattacaggtacgattgatctaaatcaacccgcatctgtgactgaaaaggacgtcgagttgctgctcgaggtcatgaaggaggactttatgaaagaagtcctctccaagtgtatcgcccctaattaaaagggacataaccaggagaattt

SEQ ID NO: 1799 - DNA, 408 bp, Beihai hypo-like virus 1
  strain BHZC36965 polyprotein gene,1
ctgaaagatagcaaacagattataacaagtaggcatgattatgttaccctgctcgatgggagtggtaaacagtcttgtgatgctgtcaaccaggttgattcctcaacccaaaatacggatggtacggtcagcgcaagcaaggccaaatataaccaaccgcaaaacccgattaaccaaagggtacggaaaaaggtccgcgtgaagcggaatgatttgttggacttggatgataagttcatacccgaacaggccttaaaagccttaagggatcaagagagacgtggacaggcgcggtccacggcgtcaaaaagacctgcctacgtttgcaatctgtgtggacgggagtgcccccatgtatgtgattatgtatatatagaattagaagattggcaaagaatcccccaccaa

SEQ ID NO: 1800 - DNA, 410 bp, Totiviridae sp.
  isolate trb102shi2nc, partial genome.1
ctcgtatccctcggtgattgaaccattgaatgacttgtgaacgtatgctcctcgtctgacaaatcctccagctccagtagatggtaattcttcgacatgttgattcatattgttacgtatgaatttcactgtgtttggttttgttgttttgtttgtgcttcgaacagttcgtttttcttctactcgttctaatggtagagtagtttccctgttgtgtgctttgtgtttgcgtattgtaataccagtattcagaaccttctatatcgtgatatagaagccaaacaaaacacaaacacaaagcacacaacagggaaactactctaccattagaacgagtagaagaaaaacgaactgttcgaagcacaaacaaaacaacaaaaccaaacacagtgaaattcatacgtaacaat

SEQ ID NO: 1801 - DNA, 410 bp, Riboviria sp.
  isolate rfb198shi5 genomic sequence.1
ctccgcaattgagttctaaactacgagggtggtatttaattcccggattacttaacgttcccgaaggccgtagaatcttgattactttagacggaatccaaaaacgtggatttcatcctgaccagtgtgatttgtttacccgactacaagatactaacctcaaaattgctttgacagcttggtcgtttgcgaacgacggggcttcaaaatacaaatactccaacagcccaccctcggactatccccctgagggacatagagctgttcattggctagtagattctcgcacagctggcattactaaaagctggctatatatatacgattggcacaatacaactggtattataaccccaaacaactttccattcttcccggatagagacgagtttgatgtatcagctgtacgc

SEQ ID NO: 1802 - DNA, 410 bp, Hubei orthoptera virus 2
  strain ZCM20815 putative glycoprotein1
ccctgtaattttatatgatttgtagtagtaaacaccagttcctccaaactataagttacactacacaaatcatataaaattacagggtgtaaagagaagaggtactggtgactacgctgcaacagtgtttcactagcttaaagtgtgatagtgtttaagtgtgtttaattgtgtagtattattgatccagtattttagatatagttactgtttgttctcgcatcttagggtttaatatttatagtatttaataacaactgtattagtagtgtaagtttgcagtgagtgtttttatcctttagcacagcctttcctgaccaaatatagagttgttgctattgttgtttcacaagttaatctgcgtgcctgcttagattagaataacttttcaatatatcagtgttacttat

SEQ ID NO: 1803 - DNA, 411 bp, Barns Ness beadlet anemone chu-like virus 1
  isolate F99 segment1
tccacttgtaggctctccgtgtcacgactgatccatcactgtgggatgcatagtcacaccagcatggttagatcaggaatggcagactatgtggttgaactaggtcgaagtgcgtgtatggaagctgtggagactcggaggatcaagtggtcaggagtcatcctagatggattgaaactaggaggggaactacacagcttacagactatagcgggtcatgtcactgcatcaggaaaatgtgaaggatcttcatactcagaccaatttgggagctggacaggagttgtggtgcaggctgaaattaagatgttcatagacagatatgccacaacagcaaacatcagaacgggggatattacgatcagagggggcctccggtgcgaatgggagtcttagtcatgtttcgacaat

SEQ ID NO: 1804 - DNA, 411 bp, Melon yellowing-associated virus
  TGB1, TGB2, TGB3, CP, NABP genes1
tttgccggggatgacatgtgcgctaataggaagttgaggcttaagactgagcatgatggattccttagtaaactgaaattgaaagctaaagtggatttcacagtgcacccaactttttgtggctggaatctcactaagtatgggatatacaagaggccagagttggtatttgagaggttatgcatctcaaaagaaaatggaaattttagagaatgcctggacaactatgcaatagaacttagttatgcatataaacttggtgagaaggcagtaggcttgatggatagtgatgctgtgagttgttattaccaatgcattagaataataatcaagtggaagcatttacttaggagcagtgtggctatagactttgtcgctaatgtggcttaggtttcttgccataaattgaat

SEQ ID NO: 1805 - DNA, 411 bp, Hubei picorna-like virus 77
  strain WHCC115343 hypothetical protein1
ctagatcctttgaaagagttgtttggtagttatattccatacccacatcagaatcctgtctccgattttcttatcttacctagttctctcactactttcaataccaatattgatggtttagttaaagtcaatggtgagttttttgattataactggcgtggttatgtacgtatagttaccggtttttctgcaacccaaattggtttaggttatggtcttcgtatttatatagagggttctgatcctagttatcgagctggtgtaactccatgggcttcggatgaaggttttgaaaatttccgtaatccaacaagtcttaagaaacgcttttctaattggaactctactgtatggtatactaatgctttaacttctaaaacaactctttctaattctggtgctagatattgg

SEQ ID NO: 1806 - DNA, 411 bp, Neurospora discreta fusarivirus 2
  NdFV2-W683 RNA, complete genome.1
gttccataaacacaccttcgtgatgaaactggtctcacggagccgccaaaatccagtgtttgggatgtttaggttggcgaccaggggcacaaccctctgtagcttggctggaacgggtgcgtgcaacgtgagtacacgcaacatgtccgtgcaagggaacctgctagccagtggtccgttaagacagtggtgtcttgaacaggccatccatttcaacatggagaacccgagtgtaacgactgcgaagtctttaaacctacaacatgaacagtctactccccaggccttttggttattgggtggtgtgttagagccccaaagcaaccttttggaccgccggcttaggcccattgatagagctcacatcaaacgtgaagtacctcaccagtcttcacccacgatacaacactg

SEQ ID NO: 1807 - DNA, 412 bp, Potato yellowing virus
  isolate Hco-030B segment RNA3, complete1
agtaaatctacccatcttcctcccaccctagcatgacgaaaatccagaaatggagattgcctggtgcgatgtaaaacacaaaattcccggcggacttcagattccttgaggtccactcggtctttgaaggtccctgggggggagttgggaggcgaccccgtaaatttactttacgcaaccgaattcaagtctttgtgagtgtcagattgtgtcgtcgttcgtgaggtgaatgctgtcgaggaccactccaattcaactcactcgtcagtcacatagtccataagacttaggaggttgtagtagtttacacccatacacaactttgttgtaagattcaattctacgacgcgttgttagttgaggtccactcctttcaatctgtcgtaaaggcgaatatcgagcttatcttaag

SEQ ID NO: 1808 - DNA, 412 bp, Hubei picorna-like virus 44
  strain WHYY20621 hypothetical protein1
cctgggttaatattaaacccagggagcctgttttgctccatttgagctcgaagataaagcttcggctttatttagagtatcatgtagaccgcggtcattcgtgatcgcctatacatgttggagcaaagccctctgatggcgaggattttaagcctgtagttcgctgcagggccatcataaacacaaccacccaaacaaaataacctacccaaaccaatcccattccttagattgatttccgttgacaattttgctattgatttgtgacgattttaccgtgtttttactggtttttccgtaagaaataaccttgaaagattacacagatgtcggatctgtggtcaaggagacgtagcatgttttacgctactatgtactgaaatctaggggcagccccccaccaaacctttat

SEQ ID NO: 1809 - DNA, 413 bp, Gengado virus
  strain Anda 1734-1 genomic sequence.1
ttctcgggccccactccgcccctttcctgcgttctttcctttctgcctccagcctccccgtcccgttcacaaagatccatcagcataaaccttcaaacaaaagagccaaaactctcctaagcaacctccgctttggctttgatggcatcctcaaggtcaagttggctcaaggtgaaggtttggaccccgatctcctctcttcttggagtcgccgtctcacctacgcacaacccaggcaagttgaactctgcctcatccaaggctttccaggctgtggcaaatcccatcccatccaacaattgctacgcaaccgacacgactatcgtgtagcagttccaaccactcatctacgtgaagagtggaaaaacgccctccacctttcaaaagaaacttggagagtgaacacgtgggaa

SEQ ID NO: 1810 - DNA, 413 bp, Beihai octopus virus 1
  strain BHZY180716 hypothetical protein 1 and2
agttgtcaccccagtcctcgagcacgacgttaaactgctccccccgttggtccatgggggttctgtatatagttaaagagacccttgtataattggataccacgtacatgtttatgttttatcgttctttctataatatgtatatgtaggctttatatttgagagtggaccctatttagggtagtgtcctcgcacaaacaagaaacaacggccctacaacttaacccggtttgtaggatgtaaataaatgggttggtcaatgtttatattttaacaattggtttctatctaagccagggacagaaactgtagatcaaaatctggttggagctgatgctctacagaagactcaccatgaatatcagggaggtgagctagtgccacagagtggcactaccgacgatgtatctttg

SEQ ID NO: 1811 - DNA, 414 bp, Beihai picorna-like virus 27
  strain BHNXC41439 hypothetical protein2
gatcttctggtgtttgtacatatgcacatatatatgtttttatatttatatacttttatactttatgttttatttttatttgttagtgacaattgtgatttatattcacaattagtacttacgtctcgggacgttaaaggaccaagtgagctgcctctcactagaccctacggggaatgggcattgtgtatattatgatttacttttacaggaatttatttctccttttgtatttctgtaattgaccctgtatatactgtttcataaaagcttgactcgctagaggtgtataacactaaacctcattgagtataaacatagtaaagtgttggtcaatgtatatataataataaaactgaagaacctagtgtcgtttcttcaggctttacacgtaagacacaatctttaaagggt

SEQ ID NO: 1812 - DNA, 415 bp, Little cherry virus 2
  isolate LChV-2-TA, complete genome.1R
cgtggtgaacgtgtgaaatcgctaaaggatttttaaagagacaaattaacaaataaaacgacggacgcaccgcaatccatcaaagtacaacaaaaccctaaaaaccactacaagaatttacaaaactcgtcacaacccaccctagtaagggtgtttcgagaaaacctacccgactcacaggacttcaccaaccgggcggaaacagaactaggagaatctaccactaccaggagctcgtcacctgccaaagcagtcctgagagcccaaagaatatgagctaactccaggcgacgagaaatactcgcacacgagcttcatatctttgccttgctcgagctgcaagtggtgcgcgttcacaaccacgactattcgcggtgggtaagaaacccgggagacgacttaactccctaaaccg

SEQ ID NO: 1813 - DNA, 415 bp, Dongyang pangolin virus
  isolate DYCS, complete genome.1
gtatgaagataaatcaaagaggtgagagtggattaccacagcaacccgcttcatacacattggactataccaaactgatcttttaggctagattgggaaatgtgaaaagaacagcattaggggtgaagggcgaaaggatgttagccatacaccgagtagcactagccctgataatatgcgagagccccaacctgagtagatgaggaaggccgtagcagtgagtacactgtagccaacaaggttcctactggtaaggatcacccactaggtatgacctgtagttgggggcatgcccaggccatccttaatgcaaccgggggttggttgcatgaatccaatagggaaatctacacagcctgatagggtatcggcgccgatggggaaaggctctataaaatggcgtggaacatagcac

SEQ ID NO: 1814 - DNA, 415 bp, Hammarskog picorna-like virus
  strain SW13, partial genome.1
aaatacgacgcgatcgccacagctgaagcaactttatgatgtcgtccacgaggccaagaggggcagaggtaacccggacgaaaacgagtgatgtcttatctagggacttttacgatcctgaagaacagcacggacaaggtgttacggtgaggaataagatccagtatcacgtccaataacagtgtcgggaacaggggagaagtgtaaaactccggataaggcaaataaatctaattgaaaggagagctttgctagactagtaaattgtgaaagcaatccaggaaatgataacggttgaattcttatactcagcatagtatatctctgtagcagagagtacttgcgaaaacgattctttgaatcactagaccttcgcgggtcgccaactcagaaccaaaccaatttttacccaaac

SEQ ID NO: 1815 - DNA, 415 bp, Riboviria sp.
  isolate brb141rna1 genomic sequence.1
atctgggaatccgcttcctaacccacccacaggatttttcctaatctggctgggaggttacagtcgctgtaatgcgtgcaccaacgtttgcgtgctgtacgtatttagagcccgatgtttttctgagtttattgccaattttcttttttcagtattttcattttattattgtattatttttattcaagtgccttgcctcctgtggttcgtgcagctatgtgtaaggttttcaatactatttgtaagtttgatcctctttggttattagcactcggaattcgcaaaacccaaatgattttatgagcaagtagaggagatttctgatgcatgtagtagtttcaggtcagccttttggcgccccatttttgggttattacagtcgcgtgtcgcttttggtaagggcttcggatgcgcg

SEQ ID NO: 1816 - DNA, 415 bp, Hubei picorna-like virus 19
  strain SZmix17531 hypothetical protein1
aagcgatcatattacagctttatgttatagccttgtgtgtgtgagagacacactcattttcctataattattttccttagtcggcccctgtgattcgggaggtctgctatgtcgtataatcacgtagatagccggtggcaatatacgtaagaccaccatgtcggcacctgtagtgggtgatttcactttttgatactgtgagagtttccagtattctgtgttatgggcacacttccattcatcctttcaatggattccaggacacgaacgcgtgcatgaagaagcacgttagtagcgatagggtttatacggccaaacagagggtgggacattcccaccagattgaattttttccggtcttggaccacaaaacaacttacgacacagatacaacatactgatatacgaatacaat

SEQ ID NO: 1817 - DNA, 415 bp, Hubei tombus-like virus 21
  strain spider121926 hypothetical protein1
agcctattgcgccagggatctcgcttaacagaacaaaggtgttgggcaccttccgatcctactgcatgtcagcaacctccagcttacggggagtgtttagcatccgtgctgactatgatatcgctaaaaactgcaaaccagtatatgacgatgtcagaaggatggtggcgatggcccctagggatgaagcaaccatgagcattgctcgcaatgctgccatacgatcatgccgggaacacaaagttgatcctgaatgcatcccagtcgtgttggcaaaggctttgcaggtgactaaatccgaggtcaatgcagctgtgcatctcagtcgccgcaaggagcgaaaggctacgggtcttttaaactccttctaccatgtcctccgaaaatagaacctgcaacctgtgttccattaccc

SEQ ID NO: 1818 - DNA, 415 bp, Cooper virus
  isolate Antarctic61 RNA-dependent RNA polymerase gene,1R
gtatgcaagcaaaggatataaccatcaccttgacctctggtgaaaagaagtttgaggtcctttctccggccggggctgagaagcccgcggagtatcgtctagctgacgattccttaacccctactgccgcgccttacttaagtgtaaaagcgggcaatgcgggtaaggtagtgggaactcgtaaagtttccatcttactcgtcgtccctgtccttaaagacggggtacgcgttgaccagtcggtcatgcggctagagtttaaagcatctggattagctacgattgcatccattaaggaggcggtcgaaatgctcactaagttagtagagcatgatagcgtccagactgctttgaagacaacgactgctcctaactagaacagtcatttaaacttaatatcacaagaggatgtttc

SEQ ID NO: 1819 - DNA, 416 bp, Taura syndrome virus
  complete genome.1
ctttaaaagtcgtgcgtggcttcaccacgcacgatcagtactatcagttaaccactcttgaatatgctcaatgaccctattcaacactggtgtctcttagtacattattttagcacttaacgtgcatgagttttgcccatttctttcaaaaaaatgagtattcgaggagacgtcccgctccccgtcttatttcaaccgtagactcgacatctattggtggacatttaattccagtcgccgtaagttgcttctgccccgcgctatattttcttatacttatggttctataggtctggtttaaaacgtaaatagacggcccacaaactatagaacgcgtacccggaacgccaatcccggataagtccctggatatatagatgcaccgcaatataagcctgcagactgtctcatatact

SEQ ID NO: 1820 - DNA, 416 bp, Posavirus 3
  strain 10611 polyprotein gene, complete cds.1
actgttctcgcacgtgtcttttgtgtggtttgtttttgtttatcgtatcggaaccatcactctattaagcctctctattgtttggcagcttcagatggttataagaacacggtcataaatgacaaaccgatttatgaatatgaaggagaagcgatttgtgatttgcatattccatcaaaacttgcttacatttggaaaactagcatgttttctggtggtggtgttataagatcaatgacagtttcagatactagaacgtttttttatgataaccctgagtttgcagatatctggatctttttttttagaaactgagttatctgattagtgtgaacaactgtgttggtgtaaaagtccctgctcctactatttcggagtatggtgtcacctttgtttatcttgtttcccatcccaca

SEQ ID NO: 1821 - DNA, 416 bp, Wenling hoplichthys picornavirus
  strain XYXMC41402 polyprotein1
gtaaggactagatactatttaaactagagtacattttctaattttgcataaactatggcggcattgaccctggcgtaaacttcgccagcaccaccaatgtcaaatgggttatgtatgattatttcttgtattaggtttatttacttctaccgaccactccttagtttccgatgctagatgtatctggagcgcggaaaaccatttatttggttagtacgagcactggttttgtttagtattcagataggtgtatgatagaaaaagtagcaaaccctcaaacgaatggccctctttttgagtaagccggaagtgggttatcttttccgtgggggcacggttaaggagcgctatgttggatgacagtctcgcggcaggtcgttctatcagcactataaataccacctgttgaccttcac

SEQ ID NO: 1822 - DNA, 416 bp, Beihai mantis shrimp virus 5
  strain BHXG25299 hypothetical protein1
ggtttatgcgccacgcacgatttaatactaccagttagtcacacttgagtacactctattgactctactcaattctgacgtctgttagtatcattgattaaataaggcataagtgctcatagcacattagttttgttttgtctctaattaaaagacaattcactcgaggagacgtcccgctccccgttttatttcaaccattgactcgacatcaattggtggacattctctatcctccgccgtaagtagcttctgccacgcgctatattttcaacacttgtggtttcatggaagtagtttaaaacgtacctagacggcctacatgccatgaaaagcgtatccggaacgccaagcccggacaagtccctgatatatagatgcactgcaatataagcctgtaggaggacccatatatt

SEQ ID NO: 1823 - DNA, 416 bp, Wenzhou shrimp virus 7
  strain beimix73547 hypothetical protein 11
tgcaaggtttgcatcccttgcacgattcactatgagtcctctttgtggcacactagtataccctactttgaccctagcttttagctacgctcatgtacgctgtactactctgtcatttttggttagtagtgttttgagttttcctcataatttgcacctttattcggagagacgtcccgctcttcgtcttatttcaactcacggactcaacatccatgggtggacatttcttaactcccgccgtaagagctttgtgccccgcgctacatttctcatacttacaggtttgcaggttctgtttaaaacgtattagacggccagtatactgcaaatgcgtagccaggattccgaccctgggtaagtccctcagtatgtagatgcaccgccgatatagccgatagggagtacgatacatc

SEQ ID NO: 1824 - DNA, 416 bp, Beihai razor shell virus 1
  strain BHBJDX18719 hypothetical protein1
gccgggagtaaatatatgtagcgtaatgatatataataattatattttcattacgttacgtatgtttgccaggtaaggtggtttaccagccatcatttccttttttcggtccattggtgatatgaccactcacccttcccattgttgttttcaacatttcagcttacatccagccgctcttgcggctctgttccagctgtctgtaagtttaacagactataatcacctatgaagctacaattagcagagttgtagtggaggagttcggttactgaaaccaaatcaagggcattgaggattctctgccgagattagatgccttatttaagttttgcgtgctttccaatttttacgtggatcaaacgcaaggtagcttgtagtcaagccgttgacctaaacaacagtactacaccatt

SEQ ID NO: 1825 - DNA, 417 bp, Aphis glycines virus 1
  isolate North Dakota, complete genome.1
agaaaattatttggtgtgagcgattatgatgtaggctcttggattatataaaataattgacccctttgttgaaaggataaatcaacctctttcgttttgaagcgtggaatttcaattcgattgtagtagtgtcattcctatttaggatacggttggacacataaataactaatcttccgcccagctccttgaactataccatctaccactaggagttgtgtaaaattatggtggtcaaaacaacaacaacaattcttcacaatctggcggttcccagtctacctcccccgctcagattcacaatcccgataaaatggtagacaatttgtcaacagacgttcaacaggaaactaatactacgtatttcgaacaacgagcagttttcgatgagacaaccttccaggctcctctctctca

SEQ ID NO: 1826 - DNA, 417 bp, Changjiang picorna-like virus 3
  strain CJLX28786 hypothetical2
tttgtggctttgggtgtctgatatcacatccaacatacaaaccattagatatcctgacagttacatttactgcttgaatactatttcaggaaaataattatattcaagagcgtgggtgctgtcagaagaacacctgggcgtttcccgaataatctatttagattagagatgaaaataatattttaaatataggtgttactcaaatattttccaaactctggtgaactataagtgaagtcactagttttataatcacttactaaaaagaataacaatattggcgtatctcttgcccaaagagatctgacttgtggttggcagattcaatccgaacaagtgtcttatgacacaaaaaataatgatgcacaagacactattgtctcttttcatgatgcggaaattggcagtagtgttgat

SEQ ID NO: 1827 - DNA, 418 bp, Husavirus ACS178
  polyprotein gene, complete cds.1R
aggacaaggctttgcgggaaaccgtgaagcaggcaggtggagaggtgaagactgagctcgctcggcttcctaagccgagagagcttaagcagagtctttccactgtcgcccgagtcttgccgacgaaggtgcctttggcacctttggcgacgatggctcgccgagcgagacgccgacagctcaatgctgcgttgaagtcgattgtagcggtagtgagtaattggaatcgctcgtttgacgtcgctcctcagacgtgatttcgaccctctgcgcgggcagtaacaatagcgcctcctctggcagttctctggataagaactgttcccagtgcgtgggaaacaatagcgcgcgcgtcttggatgattccgctaagaatctcccaactaacatcatttgcgggtcccccgcttgcagggtg

SEQ ID NO: 1828 - DNA, 419 bp, Hainan hebius popei torovirus
  strain LPSC33749 1ab protein, spike2
gttttagtcgtagtttggttaattataatgttagtttagtgttatataatatattagttggtaaatatttagaaaaaggttataaatgggtgaatggtgttcttaaacgtagtgatgttttggttatacagtatgttcaggaggcttatgctactaatcctgtgttaatgattgtagttattgtttttgtggttgttgctttgttaagtttattgttttcatattgttgttctaggcctttacataaggttgagaaaaggttattgtaatgtttttgttagaaattatatttaaagtattagctttaattattttacaccaactgctaactttgtaccttaatggtgcaagtgcgttaccagttgtgtgtgatatatttgaacctcctttttatagttgtaggttgagagaggatagtt

SEQ ID NO: 1829 - DNA, 419 bp, Western African lungfish astro-like virus
  strain FZFYG1494061
ttaacttactaaccgcttacgtaacgaatgagcacatctacctaacttacacggggggatattggtcaatttttatctatactatcatattacgtgatgtcctagatcgtttaattttaaatggggtggttcctgttttcctaatatacaagcctagtgaaaaggatttaatccaatttaacagtgcgaagagtatcttattatctaaatatccaactgccagattcaacgtttatgacgttgttactgatattcctgtgacgagagtagctattgatccagatgactttcaagaatctaaagattttttgacgaagggaattatcaatttatggggcgaaaagaaattatggaacgaatggtacaacttcactcagaaatttattaacgagtcaaaatcgggttgtcgaaacacgcta

SEQ ID NO: 1830 - DNA, 419 bp, Mackintosh virus
  isolate Antarctic98 RNA-dependent RNA polymerase1R
ggataattcccttgattaagtatattaatactttacgtgacaaaacctcctctgagttcgttcgcattgaaccaactttcgacggtggtcagttgtctttcactgcagctgtagttaaccctatggtggcaggcgtagtcgtacctatggtacgaggcgccgtccgcattactttaccgaccgaggtggtcgtgtgtggtaatgtgtgccctcagaagattaatcaatctgtggaagtgaaattcaaccttcatcagggcgctgctgatttagcagaacttcgtgctgaagtgttacgcgcaatggatattgctattacctcgtaccaacttggtaacggtattgtcccacctaccgatgcttcttttgcttcggcctgatcttttacaagcttcctcacctcctactaaggaaaacat

SEQ ID NO: 1831 - DNA, 420 bp, Boutonnet virus
  putative polyprotein and hypothetical protein2
tgtactcgcctttgtttaaaatcaatactctttgtcaattgaattgggtgcgaacttctattataaataacactcttataaaaatgcaatcctacaatttcatgtcttctattgatagacccattatactaatccttttctctaatcttctctctttcaaagatttgcgtaacaatagtagatatcctgatgactatcctctttattgtctctcaaaagaccctttcttaacttatatatctaatattctcaggtgtcttaatattagtaaaaatgtcgatattaacgagctcatcacttttaataatcaatattcctatgctattgaaaaatttaaatatttcttaaatgtctctaattatctatacaatagagaaatctttgaaaacgaatatcatctaacttggagacaataataaa

SEQ ID NO: 1832 - DNA, 420 bp, Hubei tombus-like virus 24
  strain GCM76561 hypothetical protein 12
agacgcgagccccctctatctgtgtgccggtacggagacattttgcagccattaccggacggtgcgcggattttgagcatacccgcaaccccatgcgatcatcgtcatgtcattagtaaaatcgcatggttttccgattgggttggcttcaaacgcctttcttgttttactgggtgcctgaagaacgagctggtttcgttgcataaccgacaccttgttcgtagggtggaaccagaattcaagacagtgaagcaggttgcctccaattggttatcaaagtttcctcggttcaagaattaccatcactggactgaagaggaagtgatcagccatacaacacagagtaagcgacaaaggacgcgtgacgcttttcgcaagtaccacgaggagggtgttgcagcctcggaccgccgcattaag

SEQ ID NO: 1833 - DNA, 421 bp, Pineapple mealybug wilt-associated virus 2
  strain HTS 2, partial1
gcggctgagcacaaggcccgacccagacatttttccgccgattacgttgctacggtggacatattgaaattgttctccggggtccatatattggagaattcactacgacctgttaatggtcgaactttattgaaagtcgttagtggcagcgtgagcgttgtgggcgtaggtggcttgccgctacgacttagtcgcccgcactgacgcgtctttgttagacgtgtctcgatttagattataccaccttagggtatcgtccagcgccctggtggtagtatattcgtgcactggggttgcaacgagtaatacttcatcaaaagccccacctgctaaaatcgagaggcgtgagtctccacgggtagcggtgccagtagcagatcggcaggctatagccgatgcccgatggaaaaagtacgaagtt

SEQ ID NO: 1834 - DNA, 421 bp, Strepsipteran arli-related virus OKIAV104
  cRNA sequence.3
gcagacatacaacttctatctcaattatgcttacctctatctctcttctaatactcgggttgtcgataaagccgaattacataatttatgctatcacgactagaaaaaaccttattttcagaagattgtaattacaactctactcatgagtttattcaagaatctggaattgtaacatcagatccaacattctgaatgaattggactgttctgagtacaatgagtagagaaagcttaatctcatattggattttaaataacggaacttagaaaaactctgagatgtgcaaattgaaattatatttcaagctttcgatgtcacatcagctattattattgagacacaaggaaagttgtttgttttagaaaatactctacttctagtaaaatagcaattattagaattatatttacaagagac

SEQ ID NO: 1835 - DNA, 422 bp, Possum hepacivrus
  isolate GV, complete genome.1
taaccggatacactccaaagccaccggacaggctacctgccgtgacccgcagccgagggtctcgtagggggaagtgcgcgcttctttgcgcacagccggcggccataacctcggtgaggcaggcggagtgataagctagtgtgaatacccatcggcggggaccacaccaaaccctgtcgcccgctgcggcggtgggtcctggcaacaggaggccgcagtgagtggttcttcaggggaacgctggtgggggcttagcactagtggaaccttgcgcgctgaagccctggggcggtcgtgaggaggggtgaggaatgctgggaaggtacccgaaaggatctgatcccaggctaattgtctagcccctcccgacctttttccttttatttttcttttctgttgttgactgattacatagatacaag

SEQ ID NO: 1836 - DNA, 422 bp, Chaetoceros tenuissimus RNA virus
  genes for replicase polyprotein,2
gttttcctggtatcttgtacatatacatatttacatgttttcatatttacatatttatttgttatattttattgtgacaattgtgatttgctttcacaattagtattttcgtctcgggacgttaaaggaccaagtgagctgcctctcactagaccccacggggaatgggcgctgtatatattatgatttacttttattaaaatttatttctccttttgtatttttataattgaccctgtatatacaatccataaaagcttgactcgctagaggtgtataacactaaacctcattgagtataaacttagtaaagtgttggtcaatgtttaaaaccaaatgagttaggtgtaatctcagaaacaccaacatccggtagggatacaatttctctctattattgtgatgcagatcatattaactat

SEQ ID NO: 1837 - DNA, 422 bp, Beihai levi-like virus 8
  strain BHTSS17667 hypothetical protein1
cgattggggatctcggaaggtaccttattcgccggggacatccgtccagatggtcacctcgtgaccattctggtgcgtatgtggcctggcaatttggttggagtcctcttattagtgacctttatcgtcttgctgacttggctgatgccacggaagcgaggataaaggcactaaaggagggacatcgtgagcagaagtatggtggtaaactaccaccatccataccattctcacagtggaagtctggagtgaagaagactctagtcaatggctatcgccattgggtagagtacgagattcactttaaacgcgttgagaccaactggttcactaccagatttgagcttaacgacgagtatttaccagacttagacaacccgtcagcgaatattagaagagcccttgggcttgatctttctaat

SEQ ID NO: 1838 - DNA, 423 bp, Bat Paramyxovirus Eid_hel/GH-M74a/GHA/2009
  complete genome.1
tgatagaccgggaagacaacgacaataccacaaccaacagctcccaaaatgcggaacaaacaagccccagaaccccaaggagacagcccagacaaccaaacccggcaccccgcagatccgaacaaagccccgcattcgaccccgaagcgcaaaccaaaaaaaccaccaaatctgccacagaacagccaaccaaccccaaaggacaccaacgacgcaaaacccgcttaactataaaaaacttaggatcacaaggtacaaaagatccaacagaaagacaaccagcccgactgcacagaacccgaaaacaagccccaaaagaacaaacaaaaccccgagaggagaaacaaccaatccccacacccgaacaaccctccacacccacacatagctcgaccacttgctcccaaggagtcttttcacttc

SEQ ID NO: 1839 - DNA, 423 bp, Marine RNA virus BC-4
  non-structural polyprotein and structural1
tttttgttataatggtaaccataacgacggtttaatcaatctgttattgatttagtccgtgtcctagtttattctagggactttttggtcagcctaccagctgaccttttcactcgtcacattcttgagtgaataaattgattcttctttgtgaagatgtacaactatgcctggtttctgtttttaggcgatttaatgtattagttctttttgatttgtagcgtgtagagcgcactaattgaggtttccgtcaattcctcattagcttctcctttcggagaataacgaatcacattgaactcatgcaaatcacgtatgagaactcagtattgtatatgtgtgtaggccggtaccgtatggataaatccgaaaacctgatcacatatgttttattgcttgcagaaaactatatgactcacctag

SEQ ID NO: 1840 - DNA, 423 bp, Bundaberg bee virus 1
  isolate QLD-6 nonstructural polyprotein and1
tttttagaaacaagctgcgaaaagatttcttttaaaacaaaatttcttatattatattttaagaaactattttggttcatatttatagacagttaagtcgctactgtaagctacttcttaattgttagtttaaattgctaaagtattttctacctcaagcttttaaaaacccaatcaattttttcgtgatttttaaaattttgaaaataatatcatcaaaaattttctgcagtataaacttgatcgctcgctttttaaagatcctgtttatatttgcgcttaacatcttcaaaattatctttgttagatcgttcacgatcttatctcatttggtacttttgactctgttgatattaggcattttgaaaccaaagcaatacgcgctttttgtattggtacttcacgcatattcgttaacacaaa

SEQ ID NO: 1841 - DNA, 423 bp, Wenzhou picorna-like virus 7
  strain shrimp14504 hypothetical2
gtttcggaatttcctttaataaaaccgccccgttgacccgatggggtttatgtatacagttgaacagggttgtgtgtatatggataccgtgcaaatatttgtttttcatattttgtattatttgtataggctttgcatgcatagatgtcgtcctcgtgcgatacccgtatttacgggaggttgatcacccatcaagatatgacgtacaatgtggattgagtgtgcccattgtattgtatattgtagcttactaaaacaattaaaagaaataaaaacaggggtttccaggattaccctacgaaaaatagaaatcttggtcaagattacaaaaacattaaatgcttgaatgatttgccacatgctttagccaaacaagaccctgatggttggttgggcataaattattgtgcatcttgtaatctt

SEQ ID NO: 1842 - DNA, 423 bp, Wenzhou picorna-like virus 34
  strain WZFSL80163 hypothetical1
cctaggttaaaacctagggtagatgtagagagcaatggaacattaattaaatcttaacagagatgttccatcttttaaaatctactgaaaagtattttgccgtaaccacacgtaacgtggcgtacttatacgacaaataagagagtagcacacttagtgttagaaatttttatttaaccatgcgttagatgtgactttctatgcacctctgcagacaagaagaggcggtattccaccgatagcaggaaggtttgtttgtgtttctttagcagaatgaaacacagcgctcttgcgcgctttgatttcgtcatgagagcaagatgacgctggaacagacagctattttcttaagtgtttggacataaacacacgttgtgctacgttagtaaacgagccctctcgagagttgtaagtttaacaaat

SEQ ID NO: 1843 - DNA, 424 bp, Picornavirales sp.
  isolate wpk049shi02 genomic sequence.1
ttgattcacaatacgggatgtagttacatgcttcatttttacatcataatggggggcttggtttttaataatagttcgaacagcgttacgcgcttgtcgattttcgtaaatggcaggggcttgatttaaaatttttgttacaggagctacacttttgacttttgtatcataaaggggaccttgagtttgattagggttatattctggtaacaccggtatatctctacacccatgttgagatataccggtgttaccagaatataaccctaatcaaactcaaggtcccctttatgatacaaaagtcaaaagtgtagctcctgtaacaaaaattttaaatcaagcccctgccatttacgaaaatcgacaagcgcgtaacgctgttcgaactattattaaaaaccaagccccccattatgatgtaaaa

SEQ ID NO: 1844 - DNA, 424 bp, Dezidougou virus
  strain DEZI/Aedes africanus/SEN/DAK-AR-41524/1984,1
ctccactgtctccgttccaactgttgcagactcgtgatcgcatcttgcgtgaaggtagcgcctgattttcaggaaaactcaacagttgtcggagtttccattacacaggtttcttcctcgttcttcctgtgttgttctttgaacgagaatcggttatttcttgcccttataacccgggttttattatttttgcctaaatttctattcctataatttctttactctcactatcgcacaatttaaaaatttgaacaaagaaattcatttgaatcaacgtctttctgatagtgaaaaaacatttcactaattcaagacgataaattatttcctacattgttttatacattgccaggagatcgattggatttttctgctgtaagatttgtgaatgaataagttaaatatgctttagtcaattatcatc

SEQ ID NO: 1845 - DNA, 425 bp, Mytedu virus 1
  replicative protein and hypothetical protein genes,1
gtaaggtcagtcactttggagacgttaaatccaacccagtttcaatactgatggttagcaaaattgatatatgtatatggataccgtgtttgttttaatctttatatgttttgtagaaaattcataggctttgcatatattaacggtccctaccggggagttttgttcgagttcaccgtgctcacttgtaaatatgtcgtaccatatgagtcaatccactctatggtttgtaaataaataaatggattggtaatatctttaattataaattatgccgggatgtacaagccaacataagttttggtcccggggaagcaaacgtacacaataaatctgtgtcggagacacagtcagcagtgactgaaaattctttattgaaaatagagaaatttaagccacaatctggtccggaaggcactactgtt

SEQ ID NO: 1846 - DNA, 425 bp, Termite HDV-like virus
  complete genome
gctccccgcctccagcccaatccctgtcgttgcgggccgccagtccaacggaggaattgtcaggtccaccctggatggagcttctcttggttggaaacaggcctacccggatcgtctgacggagcccctcatacagcgggttcccgagatatcctgtgccctattgcttaccgtatgtaccaagatgttcacctgttgttcccctgctttcccaagtcttgggttgtgtttcacctgacgacctcctcttcctcccctgcccgcaacgttcccgacccctcttctgtcccgatcttcgcaaagttggacttacctgctgcggtccaacggggcgggaccaccaacttattttatctcttaagagaaaattgttgatttgggtcccagcccttcgttgaggagcagcagaaccaacacagcgaagg

SEQ ID NO: 1847 - DNA, 425 bp, Shahe bunya-like virus 2
  strain SHWC0209c12742 putative1
ctttgcataaagagatttaagtgaattgaaaagttctattaaatttgtttaatgtcaagggcagttgagagacttattttgattacagtcatcgcaacactttttgtagttatcactgattttattgttgaaaatagcaaagaaggtgaagttactattttaggtagaggagattgtataatctactctggtaagaggtactgtgaggagggtagaaaactgtcctgtcctggtgtctatgaagatttctttttcgtttcagggttacttctgtcaaagggtttcacttttgcttcaattgcaggtgccatagccttactagtctttgtatacgggaaaataacaagagaattgagaagtagtgaaatagttgattcaagatttgatttagagcaagcgagagaaaagaggcttctttgtaatct

SEQ ID NO: 1848 - DNA, 425 bp, Dundee virus
  isolate Antarctic90 hypothetical protein gene,2
attggagaaataatatggcacaagccaaagacttcacgtttaatgacggaacttccgatctgaccttcgaggtcttatcacctgcaggaccaaatagtccagcagaatttcgtcttgttgatgacagcaaggcaccaatgaccctcccatacctcagcattaaagcacgaggtgtgaacggagcattggcccggaaggcatcaatcatgtatatcgaacccatcgtgaataacgaaggggtccgtacaagtcaaaacgtatggacgctcgagtcacggattgatttgagtcaaacaaccgctactacccaaaagggtgttgctcgtttgatcaaactgctacaggaggacttcatcactgaggcccttacaaaagctgtagctcctaattaaacaaaccctaatcttacatacgaggtttattaa

SEQ ID NO: 1849 - DNA, 426 bp, Rosellinia necatrix hypovirus 1
  genomic RNA, complete genome,1
gggtgtgaaaacttacacctgctctatatactttcgtattatagaggcgcaagttcgcttcgctaagtcgggttcaaatcccacgcaattttacctgttacaggtttattgcagcttaggtacacttagacttaggagtgtacatccttcaatgtagagttccgagctggaactctcataaggctcgtagtgagcacccgggattggtcgtctcgggagtagaaaagaagactactttaggttagactatcttcctttctgactttaacggctgatgcgctaactcccacaccgcaggtgtggataggttggttatttactcagagtaaaagttggataaattgtttagtttttttaaaaatgaggtactggccatagaaccagaaactgcggctaccccgcacatatcaacaaagatatgccatc

SEQ ID NO: 1850 - DNA, 426 bp, Picornavirales N_OV_039
  putative non-structural protein2
tctgcaagcacgggaagccccgtcttggggacgttaaaacccagttttgtcaactttaaagacacgagagggtactcacgttaggcaaatactctttgttcggcaggttaccaggatttggattttataagcccgagtttgccatttccttggcaccgaacgattataaaacatcggaggagttagagtggcgttgagttatgccattctttagagctatttgctcactctatacattgacttactacatatacatatacacaattacataataaagaaatagatatagatatagagggatcttatacatcccaaaacacactagaatttttgctagtgtgcacttgttgtggaggttttgttcctcaagccgatttagcagaaggagaaatctcatccgctcaggacaacttcgcacaacagacc

SEQ ID NO: 1851 - DNA, 426 bp, Picornavirales sp.
  isolate xftphe89pic1 genomic sequence.1
ttattggattatggagatatatgatggcctggcatggaatccaggaattcttacatattggaattgtatcccacgtgaacggggatgtggcaagtcccccagtaatgctgggctctacccaatgtgtgaggaccgtgacttcaagactagttatggtcgtgtgacaagggaaagagtttcttacccgcctgtgtattaggtgtgtacgctgggaaaccataagcgatcgaaggtaaagtggtgctgaaatattgcaagctcaatgccttctatcgtgagtcggtgccgctgcatttgatacacgcccctcttttggggtaaatggctgacacgggcatccgcacttgggaatgtgcggctggaactagactgggtgatagcctgccggctggcgctgttgtcatggtatagccagttgattgccac

SEQ ID NO: 1852 - DNA, 427 bp, Plasmopara viticola lesion associated alpha-like virus 1
  isolate1
ccagcactttagatttacagccacggcgtgtaaatctccagtgtttcgagttgcgcaaagcgttttctggataaatgagcattttcgaatacccactgactgtcacatcagtcattgacgtaattttcgcaacgttcaaaaccttcgcctcttcttcacccagccttggtctcttcctgaagaccatttgcaactttccaatctgggtagcttttgcaatcggtttgatctgccttacgattgacaggatcagcaagcacaagtacattcggtatttgaatacgagacatcacatcgtagagtcaattgccgagagaggtggagtcgtgccagttcagcccaagttgagaacgcacttctcacctagacttggcgatcgggacatcacgtctgccacacccaccagtgcatcacgcaggtggaacta

SEQ ID NO: 1853 - DNA, 427 bp, Picornavirales sp.
  isolate bsk136shi16 genomic sequence.1
aagagacaggaggttcgtcgtattgtcgattttgcgtatttatatgcatatccgcactgccgcttatcgtggtttcttttaaatgacatttggaaagacaaatgaacacttgtgtttgacgtttgtgtactcactatatactagtatagtgagaatgaataaatggctcgattattatgtgaataagtgaatgaaacttcaagacttagcaactcgattgtgtttagctaagtgtgcttgaaagtaacttatttatcatatgtatcgcttgaatttattttgattgcctatggtgtctaacccacaccagcctcttcatgaccctctgtgcacgcagggattaacgtgcatgcaaagtagcgctgtttgagaacagttttaaatccacaatatgtggtctttgcattagattttactcgtgggaata

SEQ ID NO: 1854 - DNA, 428 bp, Lilac leaf chlorosis virus
  isolate LLCV-BJ segment RNA3, complete1
tcagtcgatggaaagttaatatcactcaccaagtaaatcgctctttgttagcgtgttgagttgagtactcgatttcatttcgacttcgatctggtattatccgattgttgtgtttggtggtcccaaggcagggttggcccgtttgggaattgtaaatccaagcaacaaggagagcagagagaatcgtgataagttcgatctatctcagttgtaaatccgatagagaattaggagcaaaatcaacggtatcaaagcgatacttactcttttgaggacagttgattccagggttgctccgaatttctcgacgcggtggctgatacgatttgagtatcacgaggcttaggatcttcggttggacggaagagtaagggttggccctgctttcgaaagaacgactgattcgaatctgtccagagacgagaaga

SEQ ID NO: 1855 - DNA, 428 bp, Iflaviridae sp.
  isolate dwb184ifl2 genomic sequence.1
tgacattgacaccaggtaaagagaacgagggaatccgaccctatccgttctctttacctggtgtcaatgtcaacaggctccagtggggtgtctggtaatcacccccgacaagtacagtcgttaaaatgcagaccccagtaaggtatctggtacttacctccgacccggattaatatttctgtggagtcgttaaataattagcaagaaataagccgaccactggttactccctcataggtttcagagttaaagtgggctcctaaatatgtgagtgtaccgcatttttagtgagtacatcagtacaccggtctatgtgttacaacttatgaagttatattatcgagtgacagagttaacgtgagaagctcttactgctaatcttgcatttactgcctgtaaaggtaacagtgagattaggggctgagtag

SEQ ID NO: 1856 - DNA, 428 bp, Mekrijarvi negevirus
  isolate P39, complete genome.1
gcaaagttgtcaaccagcatcctcaccagatgtaattgccgactgctaagattgaacccgaattctaaacgaatttatcaatcgctcacccttgtccggtgagtccaaccagctgcctaacccgcagaaacatttcacgcgaattaatttgacgtgaatccaattgtcccagttatctggtacaaatctccgtttaaaatttttattttaaaccttttcgtcactttcacccagtgacacttcctgcagatccttctgattctgcaaaaattgtccgctcactccggatttctttgatttgttcacatcaaatctcccccaccttcattttgaagtcctgtctcattaatagtgagactcccccttgaattgttttcttcaattctcccctttttcgttgttaagttctgtcctaatccgacattacg

SEQ ID NO: 1857 - DNA, 429 bp, Mizyes virus 1
  polyprotein gene, complete cds.1
taccccctttcagtgtttgttaaacagactcttgatttgtaacccttgttgttgaaagaactagctattcaaaactagtgccatcatttgactaacccgacttctgtcggtggaaccctgtctttgacggctcttatctgcgcattgagcccagtttgctatgtcatcaccaccaagaaccatttcacgattcgtctgcgttaacttctccgcatttccgcctgattgcccattagtttgttcgactttctcgtttgcgagacttgaacgccgcacttttatgctctgctcagcatattaatccatcgtattaaacacaaacgatcgcagatttacccctgcgttaccaatagcgtactagtgatgtcgcactagcctaaccctgatcgagaccacactcgtaaccatggattccagccaagccttaaa

SEQ ID NO: 1858 - DNA, 429 bp, Mytcor virus 1
  replicative protein gene, partial cds; and protein 21
ctacactaaggtagttttcccactaactctaggagtaggaatagcattgatagcattcaccctaacaaggcccactctccccacggtcggggattcacaacacagcctacctcacggtggctggtaccgtgacggaacgaaaacagtggcctacaactccccccactactatagtagtagtttcatccctttcttagctgtgcttggtttaacactcttaatatatgtttctagtctatgttctggtcggggtgctactaggagttgccctcattgctgtggtcaacactaacaatcctcagtgtactatagtattcaccggtcattccactactatccaggggtgtgagcggttaactaatttgcatgacatcatagcagcggttaataaccgcttaagttttagctctagttgtgaaaactaactcc

SEQ ID NO: 1859 - DNA, 429 bp, Beihai hermit crab virus 3
  strain BHJJX21702 putative glycoprotein,3
ggcatcctataacaccgggtgaggactgttcagtattgttctcctatgcatgcttagttttagggtcacaggccgataagttctctgtctggaccatctttcttagtagtttgtaagtgcctgtttcatatatagatgtactattaagggtttagtttttaagtatatttttctcataatcatttagcatcataagattgtttttctcagatgaatgacagatacttctgttccactactcaaacttcccctctttctttcagagggaaggaagacggggagttggactcccagttatccctattagtccttatctcaaacctgcaattccatcagatccaatatttttgctcctaatgttgtaattggctagtttaaaagaacacccccactgagtaaacattataacacaattacacagttccaacc

SEQ ID NO: 1860 - DNA, 429 bp, Wenzhou picorna-like virus 31
  strain WZFSL72092 hypothetical2
agaacttgtccacatatttgatgcttcgggataagtgagcctccatgttgtcgaggtgaagactactactcagtctttaaaagagaggagagcgtccagagtgtgtgtcttgagcagaccacactttagtatttgcttacagaaaatcatattaaagtggatggcaatgccactgaaaaagataattgcatagagattgaaggtatttcaatcactcctaacttagagttgacgtctggggtcaccggttttgatagtgaagccacattgtgcgctgaagtgccttctttaaataagggaactttgcgggcagatggcgacatcaatcagttgaagcattatttagcgaggccatttttatggcgtactgggacttttcttgtttcccctgggccacaagagattgcaccacttaacaatcacgcagat

SEQ ID NO: 1861 - DNA, 429 bp, Beihai picorna-like virus 9
  strain BHBJDX18814 hypothetical protein2
tttgtcaaaagcctgaccgtcaagtcgttaaactgtccggatgcggaattatctgtagtcgaaactctaaggaggaaccaaaaatattctgtatatattgattacgatgtgttatatgtgttgacaactacatatatattatagcgcttgtatactgctggttgccgtagtggcaaggagtttttactcctggagaaggaccactccaaagaagtgttgtgataggcaagtgctctgaggcgagcacttgacccgtatacatagtgccttactaatttttataatttttataatactgaagttgacagtataaacaacttatacatattatatacacctcaatcgggtacggttggggtaacagatagtgtagcccctaatgtgaggagtgaaactatcacaaattttgaagtgcagaatgcaggagaa

SEQ ID NO: 1862 - DNA, 429 bp, Shinobi tetravirus
  RNA, complete genome,strain: shinobi.1
gggcggaaggccgcctcctcgccggttatctgcctccggccaagtgactagcgcttctgctctagctctcaataaccctctcttctctacaactggataaagcaaataacatcatggacgcctccaacccagtcaaatctgcccagcgctatactctctctgagctccgtgattctcgacttgcatacaaaagacaggacctgaaagcgctgcaagctatggcggcttccgcggagaggcaactgttctcttcaggaggcccaagcaaagaagcttttcacagtcttactatggacctaaacgaagacctctcttcagtgcgcgcggcctctggcttatgacgtgaggagtgagatcgacttcctcgacaaactcccgcccgttccggtagataataccaaactcggggacaggcagatacaccccgcc

SEQ ID NO: 1863 - DNA, 429 bp, Wenzhou tombus-like virus 13
  strain WZFSL80420 hypothetical protein1
aacacatccaacatgtcttctttaattaaatcaaagatatgggatgtgttaatatttccggggccccaacttgtcagcagttgttcatcttgggatttacgtgggcgctcaaccactatggaacttccatatgtggttttaatgggttacccgccatattttaaacgccaacgcgagcgtgctcgcctttggtctttgatatgtagagtgattaaataacactctggttggttataaacatatatcatggtattaattttaaacgtcagttaacaacgggtgtcttgcgtgcaaaaacacttcttgctgaatggttattattaatatggtcatatatgcttataaatggtgattaggtaaattaataccgggtgatctgcgtgcagaatcacctcatattgagatacctgttagtcatgttatcattag

SEQ ID NO: 1864 - DNA, 430 bp, Scaldis River bee virus
  glycoprotein (G), putative nucleoprotein2
gctctcaatattacacttatttactttatttctttatctatgaatttgtccttcaattatatatatccctcatctaagctgaaagacattattactttaaaaaataacatattttgtccttctgtatagttaagtctgttctcttactccatccatcatggcacgtagacaaccacatagatcaggtttgtccgagattaattacatatatgatcactgtaatgaagcacctataaaatggttaattgatggtgtaaaattgtgtgtgaatataaagaatcattggttcttccagggggcaaacctcgcatttgcatggtatagagataatgttcatatctacttattaccattatatgattaccatatggtaaaattgatttacaatgttatgattagaggttaccctgattacatctagtgtccattg

SEQ ID NO: 1865 - DNA, 430 bp, Picornavirales sp.
  isolate H2_Rhizo_33_scaffold_45 RNA-dependent2
atttagcaacgtcagagatgacattaaatatctaaagccgcctgttagggtttctaacagcttatccgtggaagtgccacggaacataaattaagaccccgaaggtcgagcgttggtgtgatcttgcctcatcattttatttctaagcagagattatagaggtagtgctgccagcgtaattccctgcctatttaggatactaatcacacagggattaggcagcccctaaatcaaagagagatgcttagactcaggtgcaataaaagtgtaagccctgttttataaatcacttgccaataataataataataatggtccgggcgcaccaataagcgtccaacacacagaaataccttctgacatacacacaagtggttctgccacagaagcggtgccagaagacccgacagttagaggaggagagcataat

SEQ ID NO: 1866 - DNA, 430 bp, Wenling rattails picornavirus
  strain XYHYC192101 polyprotein gene,1
tccgatctcggcgctaggctcactctctgagtgccctagtggtcgttcccttttcaacaagaataaaacttgtaaaaattgaaaaactttgagtaaagtataaataccctcataactgagtaaaagtctgttatatatgtttgtttgtttgtaggcatctccgtgccttctacactactatatttgcccctgtgcgtacgcgcttgtgccgtgaggcctcacgtacgttcagatgcttatcctgagggatgtagcacaaggtgacacttatactagtacctttttccctgcccacgactggacctgggcggtgtaggtgtgtctctctcaatgtttcactccgaaccgttctataacaaggttgtactttccaacctgatatcagtgtgctataaattttctatcattgtggttagtccactacccaaac

SEQ ID NO: 1867 - DNA, 430 bp, Beihai picorna-like virus 60
  strain BHBei55726 hypothetical protein1
cagcgctttatttctaaatacccttatggtagatgacatacctcctgtgtacacttaatgagtgtacatacgagtgaggattttactgtctggttgttatgaaaggatgagttgtttcccagtccctttttcaaataagattccctttgacttttataagtcactgcaatcgtagtctggaatcgaatactacgtcgagaacaagagtttaccaaacgttaacgtgcgttcatgtgagcgttttcgtttagggcttgtttttggttaaaccgagtgtttaaatatcacgagatatatacccggaggttttcactgatccggtgtattaattttaggtgaagctaatactaatacttatgttattaagggtgtcaaagcccaaaccctggcgatttctaaccatgctaagcaggaggaagctcaagcttac

SEQ ID NO: 1868 - DNA, 430 bp, Wenzhou picorna-like virus 1
  strain WZSLuoI85940 hypothetical1
ggaaggctctttgagccctcctatggaatcttggtatgatgtaattggaaggtaaagccctcctcttggattatatataaacatttttctacgttaaattagatactacgttttaaacgttagtagtatcacccttaaacatttatagtcacgcaatgttaaaactcatgacttgtacccttaattgatccggtactgacaacttaatacgattgtcatttatagcagttgaacggcactgctagtattagttcttttgtaatgaatttcttactcctcaagaaattacatttaattgcaataacgattgcagagactacttaattgtagcccacggtgtgagcatagacgctaagctcacggtaacggttagggaagcccaaaagagacgccaacccacaagtgctcttgaaccctgtattatacaatc

SEQ ID NO: 1869 - DNA, 431 bp, San Bernardo virus
  strain CoB37dA hypothetical protein 1,1
cataaaactatacaaccgtaaagtcttgtccgcttctcttcagggagaagcaaaaacttggataccgttatataccgtattctaacttggccaacgtgcactactttggtcgtaataccggtttcagttaatctgaagctataataattgggttgtttaaaacatcccgtaaaacttacgagtttaaatactcgtttaattttctgctctttccttgagtagaataaaaattttcacacttcaccgtgtgattaacttgttttccagttaactgtgaaaaccgtcttttcgtttcctgtcaatcagggagctaattctttgagattaattatctcttttctgttctctcgtaatcgagagaactctgtctttggtcctcgcaagagaaccactaccgtctatagacttctttgtcttctcttgatcttcag

SEQ ID NO: 1870 - DNA, 431 bp, Picornavirales sp.
  isolate zftwig05rna4 genomic sequence.1
gcaattaaacgagaatattgattgttaaaaaattcaaaagtgtcactgatgcctgcgatataactgagtcaggcatcagtgacacttttgaatttttaaacaatcaatattctcgtttaattgcagagcctcaaataggtatctccattaatcatacaattgatgggagcctagatgacgctattaataaatctctatcccttttttcagaattatctaaagctctatccgataaatatcaaacaaccgttaatgattatcaacgtaaaattatcgcctcaataacgtcaatttataatttatatcgtttcacaactcacaaattatctcttcaagatttttgtgttaatctctgtggagttattggtgccgctggtcttgcctccgacatcataactcaactaataataactgttaggtctcttttctta

SEQ ID NO: 1871 - DNA, 433 bp, Marmot picobirnavirus
  clone c332668_g1_i1_libraryA_2587 segment I1
ctcttgtatagtttacaagtattctacgaagggaggtgtagcatgttgctataccaatcgcaattttatcaagcgattaacaaaaacatcctgacgttactgactagctacatgctggcatgcacagtaggtacagtcattgtaacggatctgtggaaaggaggtaatttatatcacagatattcaggttaagtactggacattgaacgaaagtaaacgtcacaatgttagtactgagacacaagcagccaatgaattggctgaaactaggcgacacaatgtgtcgactgaaactttgggacgtgacaccctaaatgaagataaacgtcacaatgtcacaactgaaacggagagtagacgccataatgtacaaactgaacgtgaggcgaagcgtcataatgttgctggtgaagtcgaaaccaaacgacataat

SEQ ID NO: 1872 - DNA, 433 bp, Bremia lactucae associated narnavirus 2
  isolate DML-A_DN379211
gaagagtcaagcacacagaatatcaaacaccgatatccaagcggagaaccttagggtccccgtaggtaccgggtttggattacgtgagacggggaagtctggtaaaaagagtatcgcagatctctttttgcccattatctatgataatgatgactatacccttccgggtcgattcgactcattacttaacttaaagtttcgtaataagcgattgcggttttcaagaaaccgagatattaagtatctcccggactcgtacgcctcgttcgttagaggtaggttagcaaccgaattgggacttagtcccctaaaatctaagattttagtcggtagatctattaccactatattaagaatagaggagttagtaagggctatcattgataaccttctattgtcatttaaaggatttttcttagaaaaaggccggaaa

SEQ ID NO: 1873 - DNA, 434 bp, Anopheles darlingi virus
  isolate MAC, complete genome.2
ttgttcagcagagttattctcttcaatttcattgtttttgtctactgtattgcatgattttattaaccaggatgactattatatacatatcatcttggtctttgccacttattttatatttgctatattaatctgtgcgttagcacttaaattaaacaatcccaggcgtgggcaactgtgaggtttctttgagcatgtacgcagatatttgagtaagatagatttcaggtctttccaccaccttggcggaatgtactcctttatgctatattatcatacacttataattttactctgtgcattggcatttgacccaaattggttagggagtgggcaactatgaggcttcctcgagcatatacgcaggtacttacacaggacaggtgtaaaaattccccatgacatttttttcaaaaaacccgctagtcagaaag

SEQ ID NO: 1874 - DNA, 434 bp, Riboviria sp.
  isolate cfe153shi03nc genomic sequence.1
tgattgaagaaccgacccatgaaggtaagctattcataaatcctgccaatgtggtccaagtttcatcagtatcaccctgaggggtgtctgcttctgcttggtccgtgataccacatcggcttgcaatggctgccaccgtcgtgtcaaccgtctgtgctgtctgtcctactgactggattgcgtccatcgtaactgtataagggttacgagggaggtaatcctgccagcctgcttctgctattgggagggtgtccaaatccgtatccgaatcgtcatcgtgtggggtgtctgcgctgggtccttgtcgaatataaatccatactgctttatcgtcaatcgtcctgtacttttccatatccttcatcatctgtattcgtgggggtcctcgaaaataattgtagtttgcgtcgtctccaagggcttggtatagtgtc

SEQ ID NO: 1875 - DNA, 435 bp, Cherry virus A
  QLD11 RNA, complete genome.1
aggagggttatttggggagtgtgattttggaaatgatagtatcttcaaagattacattaatagagtaaaaaacaaagttgaaattgatttattgaatgagagaattttgaggataaacactgagatgaatcagtttgacccaaggatatacatgatgaataagatagggtttgtcactagcacatcaatgtttgaagcaggccacattgcatcaaatgaatccaaccagtcaaaaggtcttcctccacaaacaagccggccatacgatgaggtgaaaccatacatgccattgagtttgaggaattcttatgagtcaaggacaaaaggcaacaggcttctatctatcctgagaaatcaaaaacgtttatgtgatttaggatcaggctctaccttaggtttaagagttttggagggcttgaaaatgttcaaggagga

SEQ ID NO: 1876 - DNA, 435 bp, Hantaan virus
  XAAa10091712,nucleoprotein, glycoprotein, and1
ttagtgaatgtataacccttattatgtgatcattatatactactgaatcattatcaatcatatttgcactattattatcaggggaatcatcatatcagggtatgggtacatttatgggtgggaatcattattcaaagggtgggtcagttaatccgttgtgggtgggtttaggttcaggctgccttaagtagcctttttttgtatatatggatgtagatttcatttggtccttgaactaatcttgctttctttcctctttttctggcttcctctgcttactaataacaacattctacctcaacacaaaactacctcaacctaactacctcattagctgtcgctccttgattgtctttttagggagcatcctatagtagtagacaccgcaaaagaaagcagtcaatcagcaacatggggatatggaagtggctagta

SEQ ID NO: 1877 - DNA, 436 bp, Papaya meleira virus 2
  isolate Valle_R RNA-dependent RNA polymerase1
tccgggaaggctatcagcgcgaggtggggtgggagcgtctccactggcggttcggtaacatttggtctccatctacgaagatggctagtcgcttacgtggacacttcggtgcccgcgtcccgagcgctgctaatgcagcccttggagagcactggctgttggagcagtatggtcatggactagatgcgtcccttgctgtctgcgtagcggtgaaactctggcttacgccaaccattaaggatgaggctatcgcacagtttcatccttttctggttggccggtaagttcgtttccaggtgtgtcccgtccttttgcaattccagcgggcgcaccattaaggaaattgcggggggttcataccggccctcaagtccgtgcgagtacgtctatctactcccaggtagtcggtggcttgtatagagttcatgataacaca

SEQ ID NO: 1878 - DNA, 437 bp, Cryphonectria hypovirus 2
  genome.1
tttcagtagttccgcgctaaaagcgactcctttggaatcggtgatttgccgattacatggaggctccctggagggattgcctatctgaaagataagatggctgctgcacagccgtgggcgaaacgtttgcgtttacaacgcgtaggagaggtcctaacaaacaacctctaacgtggtccaggtggtgacactctccattccgtcaaggacgaagctcgtccgtgaaacgagtgactcgcaccctgaatgagaagagagaataacggatgcttctggtagttgtggagtagtgaccctagaaactaatccccagaagacctctcgctcatggatgccggaccaggtccacacctagtttaggtgttttgatggtaaaagaaacaccgcagactctgtcttgacatgaccggttgaccccgtacgaggtccgacttata

SEQ ID NO: 1879 - DNA, 438 bp, Myrmica scabrinodis virus 1
  isolate Cambridge-Msc, complete genome.2
tgagatacccgaagaagtgagttatacgactttgcacacaaatatatataagttcataactagttgttttgcaagaagaactctacggatgccagtgagttatttaacatcaagcacgccttgcaggatgtgcatattaaatcttacgcgagttacatgctctttgatatctttgagtggccggttagaaattgtctcctgtagtgcccaattgataaaggtactattttagtccctggcaagcagattcaataacgacccaccgtcctatactctttgactcataacatggttaatcagcgagagttaatatgtgcgtgaccttacgcagaaatgcacagggtaatgacctccaagtagaactagtatgtgtttgtatccctggaattgatttgaaataatgatggatgattaaggcgaagatttattcaatgaaat

SEQ ID NO: 1880 - DNA, 438 bp, Beihai picorna-like virus 14
  strain BHHK130444 hypothetical protein2
gctggctgccttagtcttgggcagacattaaatgcatccgctgtgtcttgggcagacgaaaaatgcatccaatattgtcctgggaagacaataaaagcatccctctgggcgtaacctaccacgtctatcggaaccaaaagggggcactctgtattgggttaccacgcattcccaatatgtcagtcattgggggatgacgaaggcttgcagagtgaggcattttcctcgtaaaatacccctatttaggggagtgttcgccgcacgtaagactgacgcacgctgtactggttgagtcacctttacgagcgttaatgaagacttactacaacaaatacaaaaagatttaatgttacaattaatgaggaaaatttggagtcacaacaccaaaatgttaggtttagtgatcagactccacaatgggactacaccgtagatagt

SEQ ID NO: 1881 - DNA, 438 bp, Hubei picorna-like virus 22
  strain WHSF7472 hypothetical protein 11
ccccaaaaccccccccttaaactcaacactgtagtggattcattttccgttgcaaaacaaaacattactacccgcatttatgtaggctctgtgttttctatgcgaccgttacattaatctctactctgacccactagtttataaaaccgaagacctgaatgaaacgattttccttcttttcaacctctaacgaacctctgacggcttgagaaacctgaagttagtaattatgtttaaaagaaaggaaagtcaaacgcgatgactcttacatccctattccataccgttgctccacaatgtgagcgatgcgaggtcgggactgcagtattaggggaacgagctacatggagagttaattatctctcccctcctacgggagtctcatgtgagctgtagaaagcggttggcacctctcgttacctcgcctgtacatgatcc

SEQ ID NO: 1882 - DNA, 438 bp, Beihai astro-like virus
  strain BHWZXX13371 putative protease,1
caagtatcccatggcttttaacgattggcaggctattgactttgtattttttgacttagaaaacgaagttgtggaaatatatagaggacacggccttgccaaccctgagagctttgtgacatatacgatcgatgatatcaatttgtatcaccttcatcatcgttttatttgtgacatcattgttagcgcgtatcttgagcagtatcaagtcattgtacatccgcttgtcaacaacgctgcactgcaaagtgctcttggcgggtaaacgcttaaacaaaaaacgctttattcgcgggaaagcagttgacagacctgtacagctaataaggcgcaaacgattgaacacaatcccaaaaaaacaacaaataattgacgcaaaaaactacggaaatcaccacatctctttgcaacattacggtgactccaaagacatacaaa

SEQ ID NO: 1883 - DNA, 438 bp, Yado-kari virus 3
  genes for RNA-dependent RNA polymerase, complete1
tttcgggaaagtaggatgtatctttcaaaggaaagataagctaaatgtgcggtcgcacaaggttagatggaaggaaatgtccattggcataaactcagattgattgactttcaaatagaggaatgattcgcgtcgcgtggcgcctagtttacactgggcgcatcggccttgcatataagcaaggagcgctacgtcgtagcacgcattgaaaagtccccttaagcaagggagcctttgctctatcgattgcagatagagacggtgaacaatataccgaaccgcaacagagaaagcggtagtcaaagcttacaagtcgcaatggaaaccgtgatcgtacggatcacgtgaaccgaagttgcgcaatctgacaacttacgtgacaggattaaacgtccagaaggcccatggtccccggcatcgggaatccacagaaccaac

SEQ ID NO: 1884 - DNA, 439 bp, Hubei rhabdo-like virus 7
  strain QTM26925 hypothetical protein,2
aaattttatagaactatacaaaatatttgggttaagctggagactttctgcttgtttatggaataacatgtcacaattaattttacataaacaagccagaaggccattaaagattaatcgaaaagcattaatggcttataaaaagacccctcaaaacttagatctgacagaatctgcttaagaaaaacccgtaagagtcaggatgccaaaacctacaataacatttacttgtcctaattgcggtcatatcattagatatgaaaggagtgatctaccagccgtccctttgaaaccaggaggaagtgcttcaaaataacaggtcattaattaactttaactatgagactgtattggagataatccacatcattgattatttttaagttgttaaaattttgttttctggtagctaagattaatctcacgatgcagtacaaca

SEQ ID NO: 1885 - DNA, 439 bp, Zaire ebolavirus
  isolate Ebola2
atgagcatgtaataatgggatgatttaatcgacaaatagctaacattaaatagtcaaggaacgcaaacaggaagaatttttgatgtctaaggtgtgaattattatcacaataaaagtgattcttagttttgaatttaaagctagcttattattactagccgtttttcaaagttcaatttgagtcttaatgcaaataagcgttaagccacagttatagccataatggtaactcaatatcttagccagcgatttatctaaattaaattacattatgcttttataacttacctactagcctgcccaacatttacacgatcgttttataattaagaaaaaactaatgatgaagattaaaaccttcatcatccttacgtcaattgaattctctagcactagaagcttattgtcttcaatgtaaaagaaaagctggcctaacaag

SEQ ID NO: 1886 - DNA, 439 bp, Changping earthworm virus 1
  strain CPQY105740 hypothetical protein1
gttgcatgggggaataccccatgcaacgtttgttttagcctgtggcgacacagggaggcgtttggacagcttgctgcccagcgccttgacttatcgctcttttcttttctttttctattacactttccgcaatagttctttatttcctgcaacgaaagccgttctaaaagaagtgattagttgtacatccacttttacctttctttatttacttctctctcttgaggagttcttttcagaaaaagacatggtgtgagtaggagtgagtctgatggccgagcgtggttcacgcataactggtcagattcactctggagaagcccttgtcttggctctatattcgtttgtgtaagcccgtttaggtatgtgaaacagtttagtaatacagtattcgtagtttttgaggggaaaccttcttcttcttttacttaggctgaaa

SEQ ID NO: 1887 - DNA, 439 bp, Wenzhou picorna-like virus 42
  strain WZFSL74289 hypothetical1
atcagctcacgttatttttccataacgcttgtgtgtaagtatcgttacgttccctaacgtaggttgggtaaggtgacgcttctcgtcataccatcgttattttaacaactttaagcgagcaaagaaaatttttaatttcttattagtatttattttcagtctcatatagctatatatatgtgagggttttgccacttgccctttaaaggttaaaacaaaacactattataactagctaacgactagcctacctctgagtgttgttagagcaattgtaaaactctaacatcaacaggttcaagggcgaagtgccacagatgttataaggtgtgtggtcaattgcaccttgatgtgcggggagtgacgtcctacatacaattagtcacatacatgatggccaaaggggatgcttcggctgaactgagtagcaacacaaaat

SEQ ID NO: 1888 - DNA, 439 bp, De Gerlache virus
  isolate Antarctic85 RNA-dependent RNA polymerase1R
taatcacccgaggggtcttacccatgcaaaatgtaacactaacaatagcggacaaatcttatgcacgttttcaggaaacgccagataaaacaacttacgttgcttctggccattctgtcggcgatgtcgatttgctgctactcggccgtaccgtcccaaccacaaccagtggtaatgccaaagttcgcgccaacctcgttaatgactttacgtcaggaaccggggatgataagaccgttattggacgagcgtatgctaatgttgaaacatcggtgcctgctatggcatcagatgaagacaaagcacagctgctatctgatttacgggcctacgtggcatcagaatcttttgccgaattgtataataaacaatcgatctagtatggaattacccgtactagtttaaatagattgtaaactttaacaacaaggttaagatt

SEQ ID NO: 1889 - DNA, 439 bp, Hubei sobemo-like virus 13
  strain WHYY18840 hypothetical protein 1,1
atatccaggtggaagagcctacacgtgtagagccagtgcaacaggtatacattccagaagctccatatcaaactgaacagaaccatttaaacttgaggacggcctctgccattgcggaggccagacagttgaggcagggcgctcctgttccgccaccaaggagtgtggcgggaccagtatctttgagtttgcagaggcagacggttcgtacgggtggccaacaatcgattcctgcagtgccaagcgtagtttcgcacggcatttgcgaatcgcagcagggtcgagagttgatatcccgtggagccaggcgcaaacgctcgaagaagcagaaaccagcgttgtcgcaagacttagttgtctaaagcattatccgcaatatgcagataatgctgaagacaacctcaattggttgtttttggcggcggttttggatgttgac

SEQ ID NO: 1890 - DNA, 440 bp, Ceratobasidium virus A
  isolate Murdoch-2 hypothetical protein gene,1
attcagacctcccacccgacgacagccccacacccgactcgcgtttttttcaaaaatataaaaaccaaaaaaataaactacctttacatccaccccctgtttccaagcaccagcccgggtcgacagccgacctaaacctttacggccataagccatgggctccctactcctaccctgacccgttacacacaccttacctctctctgctaaaatacgcagcggagacaaatttacatgctcagaaccatgtcctcgccttgttactgaccatcacaaagcacaacttctctgactttcaacgactcatcgaccgaactcgcaacaaccaccttctccaactgcggaggagacaagacgctgcgttcccggatatctcttttccaccgggaccaaggaacttcccccgcttcggcaaaaaagacgagctcaacctcgacctc

SEQ ID NO: 1891 - DNA, 440 bp, Ceratobasidium virus A
  isolate Murdoch-3 hypothetical protein gene,1
attctgtcctcccacccgacaacaaccacacaaacgactcacgtttcttcttaaaatataaaaaccaaaaaaatgaaccgactctacaaccacccctgtttcacaagaaccagcccgggtcgtcagccgacctaaacctttacggccataagccatgggctccatattcgtatcccgatcccctgcacaccccttacctttccctcttgaagtacgccgccgaagtgaaccttcacgctcaagaccacgttctggccctacttctgaccatcacaaagcacaacttttctgactaccaacgcctcattgaccgtactcgtgacaaccacttgctgcaacttcgacagcggcaggaaagcgccttccctgatatctccttccctcctggacctcgcaactttccccgtttcgggaagaagactgagctcaacctcgatctc

SEQ ID NO: 1892 - DNA, 440 bp, Hubei rhabdo-like virus 5
  strain WHSFII19440 RNA-dependent RNA1
tccatctcaagtcatcagaagaggaaagtgcaggaagctctaatctaaataggtaagttgagtgatctttatatataataattttaggtaattgtattggtttttaataataaatattctctttttaggacccacgtctgaaggaattggatgcatcaagtgtcaaacaattgtcagatgttagaaatcacaaagttgaaactgtgcaatatatccccaaaggggtacaattaagtgttttgtctgaattgtattttctaggagatagcttactataaattgatcaatcaaaaaattattttgtattattgatgttagaattagctttagtgattttgagtgtgattcacaatcaaggtaatcatacacttctttaaaggactttgttataattatttattctctattgttttaagaaaaactaacaagtcaaaatcaca

SEQ ID NO: 1893 - DNA, 440 bp, Unknown
  Description of Unknown: Mutant Zaire ebolavirusisolate Ebola6
tttttctcgagattgcttcatggaaaagctcagcctcaaatcaatgaaaccaggatttaattatatggattacttgaatctaagattacttgacaaatgataatataatacactggagctttaaacatagccaatgtgattctaactcctttaaactcacagttaatcataaacaaggtttgacatcaatctagttatctctttgagaatgataaacttgatgaagattaagaaaaaggtaatctttcgattatctttaatcttcatccttgattctacaatcatgacagttgtctttagtgacaagggaaagaagcctttttattaagttgtaataatcagatctgcgaaccggtagagtttagttgcaacctaacacacataaagcattggtcaaaaagtcaatagaaatttaaacagtgagtggagacaacttttaa

SEQ ID NO: 1894 - DNA, 441 bp, Avian metaavulavirus 21
  isolate APMV/dove/Taiwan/AHRI33/2009,5
tgctgtataagcatcttatgatgacatataaaactgttgcagaaacatccaagttaatacacaaataagttatgtttcaaagggggtaatacactatcacgagacctaaattattaagtacacactaagtaccactgggtcagacagattgagtcttctaaaatgattgtcgcaaataatctctatgacactactgcacttaactattagatctgaccaatactatgataaccagtttcttgattattgatattctgattcgcagttcaatttatgtgggttaggcttatcatatattaattccgccaaagtagggggaaaggtttctcaatcagtagtgacagttccaggtctcttcacaattactgttcttataagatattaagaaaaaactaacaattcagcagggattaaacaagagacaattgggggagaattacc

SEQ ID NO: 1895 - DNA, 441 bp, Solenopsis invicta virus 8
  isolate Formosa, complete genome.1
ttaacgaattcgccctttgctacggcgggttgacggcatagttatttaatcaccagtgaatggggtgtgtaccttcacaaaattcttaaacggtttacgattctgatatacgacacaacaattttaactgatctcttatgacgacaatggaaacatttacagaatatactagcttgccatcaacaaggaattctccagacaaagttttgcggttttctattgttcttggatgcatttttatactgaccttgcttgttattatgactacgattgagattaaagaatatacagaacgaagacatcttgaaagaattttgatagagatagaaactcggcgaaattatgtagaagagtctcttttgaaatcaaaatctttcaccccgattgattctgttgatttttcacaaacatcaacagttcactctcactatattgatttta

SEQ ID NO: 1896 - DNA, 441 bp, Picornavirales sp.
  isolate ltt163pic3 genomic sequence.1
atatcgtcccggcgactagccatccaggaactgtaagtaccaaggcactcgaggttcccttcatccgatagggcataaaccctgtgatcaactttcttaccactagtcggtccagattttccgattggcttttcggggcagatactagcttcatcctcagattgggcgtcgtaataaccatccgaaacaccatcatcagaataatcctctgctggggtagaatttaggttctcgacttcttcattcatctcagcaaaggattattctgatgatggtgtttcggatggttattacgacgcccaatctgaggatgaagctagtatttgccccgaaaagccaatcggaaaatctggaccgactagtggtaagaaagttgatcacagggtttatgccctatcggatgaagggaacctcgagtgccttggtacttacagttcctgg

SEQ ID NO: 1897 - DNA, 441 bp, Hubei zhaovirus-like virus 1
  strain WHBL52766 RNA-dependent RNA2
cctggatgatactggggtgtaggtaagaggcctacacattgaacaacatattgttctaattacgtaaggtatacggtgtagtcagctctaataagaacaactggctatattcatgcacatatcagtgaaaattattattattctatatatataataaaattcaagtgcaagtacagctttaaagcacgccctaccaaggaccgactgtaagttttgctgaattaataaacttaatgtagatattttgtcgtttgtagaaataaactaccactactgactgtttagtggtaccattcattgggttgagtggaaaagacattctcagttgataataataagaacaataaaaacaaaaagcccttaaataaaagaaggcaattgaaacgagatagacgtgtggtggtctaaaaatagccatataaacgttaacgtgtggtggtg

SEQ ID NO: 1898 - DNA, 442 bp, Hubei picorna-like virus 82
  strain spider133992 hypothetical2
tctttacgaaaatttcagagatattctgggagtccgcgtgaagcttttcctgattaacatcaatatcgtggatgacaaaatacaaaaattccttgactgcgttgataggatatttttgccgtcgccgccccacgcaggaaatgggtttgtaatcgctccctcgtaaatccgaagggttgaggtagagtggtggcgcccatgtagccttacgagcagatcgatgcgtctcctttgtctaaattgacggaatttgagcgtattgaacaattcatgtaaccaaaaactttttctttatacaaattttacttatcatgtttctgaagtcacagtagcttacaagactttagttagttgttcaggatgaactttaaaccatatgggataagtggttgaaactttcccgagagtggtccaggatggactaaaaaccaataaaaatttt

SEQ ID NO: 1899 - DNA, 442 bp, Changjiang crawfish virus 1
  strain CJLX30787 hypothetical protein 11
gctgcaagtcccttttgggacttgcagtcagtattattgtttaattgcgttattgagcgtttggtcgtttagaccaacctttagtaatgtttttatgacatctttttctcggcttataaattgccggcttttgcgaaaatttacaactttttcatgccaccaacacttttacgtggtacactcccttttctgttttaggaggctaatctagcttgattagtgagaaaaacaacgtatgtatcttggatatgatccgtttactctatgagtattgacagaaactttttatcttagtttagtaaaactaagcatttctttaaaacaccttagaaatgaccacaggtccttagcatcgactattttatatagttaattttgggagttatagcccaaacactgtaaaatgaactatcagtgaaaagttagtcaaccataccccacc

SEQ ID NO: 1900 - DNA, 444 bp, Nackenback virus
  isolate OTU38 RNA-dependent RNA polymerase gene,1
agacaacccaactcaagacataagagacaccaacgaacttcaataaatctcttaaaggttgtctcacaagcaggcccaatgataagttaatttaaaaccttttgtctgcttgtgaacctgatatcatcaagaatcgagcgtctaacctgaattttgaatattttgtccctgctgttctcgttggaaaaaggtttgttgtctctatatgcttcttctctttgatttccttattgtaattaaatttaaatctgcgttatatccagattcagatgacaagtttctaattttaccgatagatattctgcataacttatcagctgaacgctcaacctttccaaacctgaattgaacattggtataatccttaagaggtatgtacatctcttaactgttcaaaatatcacatttgatggtgactaacacatatctttcatttaaacagag

SEQ ID NO: 1901 - DNA, 444 bp, Soybean leaf-associated ssRNA virus 1
  isolate SaSSRV1-1, partial1
gaaaagaaaaggaattgcactcaaagttagttcttcaaaggaagattgcaaagaaagctctagtgatggcaaagatgtagagaattttatcttgaacagagtgtgctgggaaaatttacccgatatttgcacctactaaagcaaaattcgggcgtgtagactctaacccgttcgcgggggtgagcatcctgcctccccgggggccagcatcttcctgtcatgggaagagcggtggcgagcctgcttttagaccggggtcgaaggcttcgtaacgtggcgccacttggtacacgctttgggaaatgatgccacggcttgtcattccttctgattgtcggctgggaagcttgaaatatcttcgggcctgggaaagcccttaaatttcccccttgactggggagatccgtctaacagggggtggtggccaacaccgttcatgaaact

SEQ ID NO: 1902 - DNA, 445 bp, Marmot picobirnavirus
  clone c322866_g1_i1_libraryA_2590 segment I1
acaaataaatataggaggaagtgtctatgaaaaactgctttcttaccattgtgatggcgataaaacattggattctcagcgtactgttacgtaggtacgcttgtagaaagaaacaaaataggcgaagcttcaaatcgctcacgaagcaacagaaatatataatttataaagactttagggaatcgccctctaaagcaaaaggagaacagtatgaagaaagagatcattgccactaatgttattgaagcgatggaattagttgacgaagatatgcgtcaggtcatgcagagttggtgtcgtcaagatgtgatgtttagacatacaacagctgataaacttgtatctaaaggtgagagatggatcgctacactcactattgacgctaaacgtcctaacattcaattccagtttctaactatctactatatttggaaggtgtctaaag

SEQ ID NO: 1903 - DNA, 445 bp, Beet necrotic yellow vein virus
  isolate YJZP25-5 segment RNA3,1
aaattcaaaatttaccattacatattggtatttatttaccctcagttggtgatatatgtgaggacgctagcctgttgggtttcctgaccgaccaaatccaagcgagcttaatccaagtacctcgtctcaaattgagtgtcaagtgaataagcatagtgaccccatcgtttcagggtagttgacggctattaatagacatattacagacgcttctctttatttatcaccaacatgggatgtaatgtttatgcgtgagcctatggccgcattgtaaaattagtggttttgaatttctattcttcggaatatacaaggtttaaaagaccagcatttgggttaaaaatttttaaaccttactatctttaactagtaactcgaattcgatttatattcagattttgtatatcaagttgttgtgttttctgatcatcattaagtggccgtc

SEQ ID NO: 1904 - DNA, 445 bp, Hepeviridae sp.
  isolate sbr121hep1 genomic sequence.1
ttctagtcatcatcaccgtcacgatcatagcaagcagcatttactatggccaccggcgtgcatcacgacgtttgcggtttccgcgagataaatgggcagacgcgatgcctgagctgcatggcgaagccaggcaacaatccatccccttacgggaagcatcaaccggggtgtgagtgggtggctgccatctgcatactcaccggccaaccgaccttccccgtgtgcaagctacactgtagaaaccgctacctttcaaatcaatccgtctgcacgcataccacacacacaccatccactctgtgccccatctgcagcatgaagaacagaactttaccaacagtcagcaagtgctattcagcccatcaggccttcctgggcccactccacgccaaacacaccagagtttgcttgatctgcaagcagcattcggtatgtttagtgtgtg

SEQ ID NO: 1905 - DNA, 445 bp, Scaphoideus titanus bunya-like virus 1
  isolate St_USA segment S,1
actacagctgcagcacgctgtgcctatatcgtatgatacaatacactcttgaagttaacaaaccagaagacgaagacatagttttaactgtagaggacttatcttataggttatccatttcaagtgagggtcatcccttagagacacaaatatcatattgtaattgtagttgtaattattattatagttattctagtgtgggttactgtagattatcatattttagtagagttattaatatcaatagtagtcttacaatacattattcagggagttatttagaagtgttagcatttgtaaatacaataccacaaagcccattcaagcaggagatttctcacaaagtgatattagatattcacaggtctgtaaggcatcttggtgcactttataataacaacaacacacttagattcatctgcaacaaccctttaccgtcaccacc

SEQ ID NO: 1906 - DNA, 445 bp, Unknown; identical to SEQ ID NO: 488
  Description of Unknown: Hepatitis GB virus B genomic RNA.1 sequence

SEQ ID NO: 1907 - DNA, 445 bp, Picornavirales sp.
  isolate H3_Bulk_Litter_16_1558 hypothetical1
ctcgaaatgtgagattggcggcaagagtacgaaaatgatgtttccagtgattttggattgaatcaaactggaagagctattggcaaaggagttctgtaacagcgacatcatcgccagaccgggcactagaaaggcggtatagcgaaccccggggtaaacttgaacgtgctcttccagtacatgggagaaatctccagagtcaatgtgcatgactaccgtaaaaagtacataaacctcgtgccaactgaaattttcaacttcccggactatgacctcgttgttcttcgactaccccctggatctacaggtggattgaccccacaccgttctattgaaaaatgctgcgtaagcgaagtagatgaacacggcaaaccacatccgcccaccatctgggtcaacagaaaactccggtacattaattatgacgtaaacaacaaacactgcc

SEQ ID NO: 1908 - DNA, 446 bp, Sugarcane mild mosaic virus
  isolate PSR07106, complete genome.1
tctttatctttaccggcacttccagcaaagaagtcattcctgactttctctgttgttccactatcattacgccagcgcccgcgctcccattcctgtaaccccaggctgttgtctagggttcgctcctccaccatcgccacaccagcgccctcgctctccttcctgtaaccccaaacttttgtttagggttcgtttgttctcaaacactctcacgctcaacccgttcgttttcccgtctctgtagaaactctgctctggtgtgtttgacctcagtcacgcactgtttacgcttcttctttttccaaaaacacaaaaagatttgttgtttcgtttctgtagaccagtagtagacttgctcccttttaccccttcccttcttacctttaatcctcaaaggttcttttatctcaatatcgtacatacctttcgccttctagttttccagt

SEQ ID NO: 1909 - DNA, 446 bp, Hubei noda-like virus 4
  strain WHBL72570 hypothetical protein 1 and1
cctttcgtcttttggtggtggccggcacggtcgcggccgctgccgcgtcaggcggctcgggacagacatatctcgagttcttttttggtcaagtcgggagcgccgtcgcgtacttttacgcctgcgcctcgactggccccttgtcggccatcgccaacaccatttcgaccggtggctggtttaccgccgccgcgggccttttgtgctcgcttttcgtggaactagcgatagcgctcggctggctcactgccaacgcgctgttgctcgccctgggagcggcacattggctcgccgccgccgtgcctttttcctttttctacctctcctgcaacccggtggccgcggtcgcggccgtcgggttggccgtcgccaccgcgtatgtcttgcgccactcgcaccgcgagttttacgcgcggtacgtgggccctttcgtcggagacgccgac

SEQ ID NO: 1910 - DNA, 446 bp, Hubei sobemo-like virus 16
  strain WGML146458 hypothetical protein 11
acgatctatcacccaattttctcacggaatttggctggcccgatttgcacgggattcgtgactctctttgctatcacgcaaagaaagttcatacgacccgtgcatcgacggttaagccaacggaggatgaattcaataaggtttgtttttatttggagcaagcatatgcgcctattcgctcggccaaattggttgagctgaatcgacccacgctgcgacgaataatcttaacacaactggattggacttcgacccccgggcatccatatcggtgttacggtaccaccaacagggaattgtttaaattcgacggacttgatgttgacgacgcgcgttttgaagtgatatattcggcagttgaagcacgatggcaggaactcctgactcggccttcggcagaccccattaatctcttcatcaagcgtgaacctcacaaaaccaagaaa

SEQ ID NO: 1911 - DNA, 447 bp, Hubei odonate virus 10
  strain QTM133243 hypothetical protein 1,2
taaagtaaagacagatagcaattgctgggtacaaagaatttatgcagagaatactcatcaaataataggaaagaacgagaaaagcactcaagcaggatacagcacatgttatgtactatttaattgaagatgctgtttcactttaaatcatgcaacattctggaataaggtattgatgcacatataatattcttataatgtgttctgttagacaaaactgtattataatattcgatgacacctgatactttgtgatttcctgtaatctacctatgatatgatggtagagtgaagcatttcatagttgatatacaatcaattgtaaagcaatctattaataaaaagacaagtctccaaaggatcttaaattacatcttatcagaataaggaattcctagtgattcatcaatccttgaatgcccagtcagagataaggcaactataaac

SEQ ID NO: 1912 - DNA, 447 bp, Lactuca sativa picorna-like virus
  strain pt151-pic-8 genomic2
gggatttatacgagttgcgaccatggggcaaacccccgaaaccctatttagggtggcagttggtcgagcctatccgcgtcctaggagaatattgtgagttgaaatattttccgaagacaatgactcgctgaaataaaaacaaaacaaaatttagtcacatttgttcaagatgaatatggtcagagtgccggttcaggagctatccttgctgacccaaccattattcatacagatgaaggtgattataaagattttttctctcgaccagtcaaaattgcatcatatgattggacagagggtaattctgttactggacaaattagcccgtggactttgtattttcagagtgttcccatagcagcgaaattgcgaggtttttctcgtttgcgtgctaatttgcatatacgtattttactcaatggcagtccatttcggtatggggatatc

SEQ ID NO: 1913 - DNA, 448 bp, Southern pygmy squid flavivirus
  isolate 201405, complete genome.1
ggagtcgtgccatgtgcaccagcctgtaaaatggccttctttgaagatgttcctaggttaatgaacgtctaaccgcccactctttggttgagacaaaccttctgtgtttgttctgagtaggtaaggttgtgggggtgtgtccccccttgcgaagggaaaaaaggctaatcccttgcaggcggataatggtaagccttgtgtgagcacctgaacttccatgactcgtttgctttaaggggagaggccggatttccttgagctagttaaagttttacccctcaagggatgaagactagtcgcggtagtaaccttcatcagctttaacttttcccatcgaaaaaaccgtggggaaccccaagctagcccaaaggtgcttggggaggttgccagtgaccgccagaggataacctgggcacactggtatcaaatctaattattaattctcact

SEQ ID NO: 1914 - DNA, 448 bp, Culex Iflavi-like virus 1
  strain CIVL1/Sutter, complete genome.1
acacatacttgtctagcacctgcattccaaggagtattagcgaaaacctttttcttaaaaccaattcttaattttaagtacaaccctcgcagaacttacaaatcgtgctcacgccttttgttatgtttagttaatttgtagttgaagaatttggacgaataatataacgtgcttattattcacgagaccctctaacgtttttaacgcattgatctcgtaaaatctgaagactgatcttacattgacattaaattaaacaaaagaaacgcaccacgacagtagtgtggccttactgttaaaacaactaggcctaacgagtatttctaactgtgacgttcgatgaatcattccgaactatgtactaactgatctaaatcgttgttctacaaggaccgtttcaccgcctcaatagatcctaactatagaggaaaagaaacaacaaacaaac

SEQ ID NO: 1915 - DNA, 448 bp, Bivalve RNA virus G2
  partial genome.1
aaaacccacgtttctaagtttactcgccggccaagaatggctactggaggcacgttggaagctacttatttctagcataacaagttcagtgtcgaggttctgccctatgtttgcagatttaaggtgctgggtacgcttttaggtctgaggaccaagaattacctttactactgtacaatatcaacatgttcgctccgcgttcgggagcccaccctactgtaatttcgaaaaacagtatatagggcctagcaacatcaccacgatttgcgctggtgtgagctggggtctatgttacccaggtgggaatttcattccttatttcaaggtaaggatgatcttaggggttgagataccccacgctacttgagggcatggcctatccatgacttgcgctaaaaattacgttgcgtatagtaatcacgttcccatttctctcaaaccatgaaaa

SEQ ID NO: 1916 - DNA, 448 bp, Sanxia atyid shrimp virus 3
  strain SXXX37589 hypothetical protein 12
aataccggcgtcacgagtaaggaacgtgtggacagggcggcctgtggactcgtaactatttagttttaccacctaggaccgagtttaaattgtccagggaagtggcgtcactcacgccttgttgagtcgcaaggcgtgtgtgaaatgactcgccgaaactacagaccatattaagagagtagctactgagactagcagagatgagactgaggtttgtgaggttattgaaggtctcacaataaataatgacgcccaacccactggagtgaccagcttcttgcaagaggcatgttcatcagtggaagttttgggtaaacatcacaaaccgcctcaagttttgaattatcaagaagatgttcagaacttgactgattattttaaaagaccccggttgatatccagaggggctttggctttgtcttccattgcttctcaagggcagtgggat

SEQ ID NO: 1917 - DNA, 450 bp, Wenzhou picorna-like virus 23
  strain WZFSL85852 hypothetical1
tgcccatacggcatccttgttgatagtttcacctttcgaggtgacgtcgaccgaaattcctgtttatctaggttgtaatctagtctattagtgtaattgtacatatttatttatacactatgtaaatatttgtaatatattccccagcggatttgtaatatagttagttttgttagttttccttgagaatttctttttctcaaattttagcaatcgaaccctattggatggcattttggaattgaacgacgcgaatgttcacttcttcgtagtctgaccccatttccatttttccattagttcgctggttttgcgttacgccttttgtaccttaaaaagatatgtgctgcgcactttggtctggactagacctaataaaacttgttccccgttgtgcttatgtgagtaacgcacgagtacgtaactcaaagactcacatatattttaatt

SEQ ID NO: 1918 - DNA, 451 bp, Guangdong red-banded snake picornavirus
  strain LPSG108441
ccttagggttatttttattgtaactagttggaacaatttacaacaactaagctactttacctccggtctcatgtagacatttggggtgactgtcatgcggtggaacacttcctgtccgtttgtacatggtatttggtttcactgatggctttgtcgctaccatctaaatgcttgagttctttttggatgataacaatattcttgtttcttggttggattatgtttgcctggcagaaaggtgttaaccatgcactaagtatgacatgcaattcccagccaagggcgaactgtacattgttgagtgcacgttagatgttagctagggaactagcttaaccaggatatatccgacattgatacgttggtagtgggggttgctaccatttatgcacacagcctgatagggtcttgaccagagataatgtgcagtataattggtctgtccgtataa

SEQ ID NO: 1919 - DNA, 451 bp, Beihai picorna-like virus 30
  strain BHNXC41477 hypothetical protein2
gtctggtgcggtaccgactcagcagcgcctggaactcaggcgcacagggctttgtagctgcagatgtcttctttttcctgtaactacaagcaatgtggacgaggggccacaacagcaatccaatcccccacaaggtagcgcaccggccgtgaataagccggtagagtatggatttactccacccgaaatctccaaggatcagaacgtaaaattcttggatgccgaggtaggcacgggtgatacacgtggtaccccttccgatcctctccgtgattctactttgatcggagatgccggattgggtgatttcttcaagcgacctataaagatagcgagttttgactgggccacttctgtcaaactcaatgaacgtttcaatccgtggcggttcttttgggaagatcgtagggtgattaatcgtattgccaattacaaactcctgaaggccacc

SEQ ID NO: 1920 - DNA, 452 bp, Erysiphales associated totivirus 22
  isolate PM-A_DN31210 coat1
aaaacgaagaaactacctctcacaagttgggagagaagctgtatagaaactcaccctcggtaaacattcttacggactttgaacaagagctagtttcgtacaactactcacaaaagagtgaacgcactgtcacgcatgcctggggttctaacttggttccctcaagcatacgcgtgtgtggtgggcgcgtgtatgcctcaccatttgaagatgctactcatgtctacctcagaccgtacgcaggaagggcatgggaaggcgaagacgtctggctgcatatactcggctgcagcacgcttgccactgtgataacgattgccgggcgtaagcactcctattacaagctagatcagtactgccggtattcagatccttcgattattgctgtagtatcacgacacttgacggggctgtttgagtcactaaacttcaaccagcctaatgatgatact

SEQ ID NO: 1921 - DNA, 452 bp, Bombus-associated virus Pic1
  putative structral polyprotein gene,1R
tatctcacgtcgctcgtacgcaaacgttttacaccagattcgcttggtctacaacggctacagcaggttcagtgttgtttagcgcgcccatcaccccaaacttctatcgttatactatatccgccgctcagtacgcccctacaactttagcgtataccgcagctgcttttaggcaatggagaggtggaattaatttcaattttaaatttgttaaaactaaatttcattctggtagagtaagaattatttatgtgcctggagattattcagcgggcacaacgcttcctgacagctttgatatagacgctaattattcaactgtggtcgatcttcgatcagatacagatgtggaatttaatgtaccgtatgttgctattcaacaatggttgttagtcgataatgctttccctggcacatcgcgtacgaatttgtttagtactggcaccatttat

SEQ ID NO: 1922 - DNA, 452 bp, Wenzhou tombus-like virus 1
  strain RGYQSMGReov43160 hypothetical1
tgggagtgtatgagcccttacaaaccttgtgaggatgatacgcgatcgcagtcccgacttgtctccagacgaggttagacaggaagcagtgttgcgggtccgacgggcccggacagctcctgagctagtctggggcctattcgacgctgtgaacaacgcctgggaaggcacccctggacagttcgcgagtacgtgctgggatctctccgcgcttctgcgccacatggccatcggcgccaacgggcgagtgcagacagtccggagatcagaccggtgcttagcaagagccgtccttgaaaacgcatttgggaggagcattaggcgcaacctaagccttcaccgctcctaccgccatcttcccaggaatccaaccctgcgcgaggctttcctcgctgagagattggtggcattggaacgccgaatagttcactacacggtgacctggtcggacg

SEQ ID NO: 1923 - DNA, 453 bp, Sclerotinia sclerotiorum hypovirus 2
  isolate SsHV2 RNA-dependent1
aaagatgttttcattaatcagtgaacgaaagttaggggatggtactcttagggttgatctataaagatcctaactaggaggaaacatggccctgtctcgtgatgatttctttgttcaatcactaaagcttctcttcaccaaaaaggagagagctttgagagcttagctgtttcagctatttgaaccccgaaggattcatgtcatagacatttgacttctatttgaagtcgttcattcgttcatccgaagatgtaaaactactgcgcatgtgcgtgatggtcctgaattttcagagtagaacggcagggatgattgttctgtggagtagtgccctagaagaacaaatcctcattcccactcttgaaagtggcccatggcaacccgtgatgcccggatcgtcttctggacgtaaaaggttagaggctacgagagactgtagagaccttggtcaaa

SEQ ID NO: 1924 - DNA, 453 bp, Beihai picorna-like virus 7
  strain BHNXC41478 hypothetical protein1
ctgcagggtattcaccctgcagtcttgttggaatatttgatagtatgctacttatgataattagctcgttcgggtattctaacccgtcgacttaattacatagctagtatggtattgtatgtattttgacattttaatctaccttttttgttattttattatggttaaattaaaatatcgccttttcgtcttccaaaagacacaaaactattggttctgacttcgcatgatcaggtaattaacacttcgtgtaatgcaatctccagtactttacagctgattcaaactggattaacaacttttggaatcgccgctaatacacgttacgtatatgacgtgccctttgatggtacgcaaggtgtctgtcctttttacagaacgcggtttaatgggctattatatgccggccatgcaccgaagcactatttgtgcaagcaaaacaggtacgctcct

SEQ ID NO: 1925 - DNA, 454 bp, Botrytis cinerea fusarivirus 1
  complete genome.2
gttagaagccgtctagctctcgacgttaaattgagcagacatttcgtttaagaagggggctagagaggtagcctggtgtaattcctcaccccttaaaaagttggttcgcagccatccatattcttaaacggtccagaaagtgtaaactggaacctgtgaaaattaaactaaggtggtgacttagataacctgttgtgagtggacgctcaccctcaagtgaagaaagctggatttgtacaggaaggcacttagtaagggtgtgggtgttagatgacgagtgaactgagggacccaaaaggttgcataccagctcggcatctgcccacacttctgaaacagtgagcaccccaacaaggaaggttctccaagcttgattgacagatgtgtccactgaccgggcgaaagtgccctgacggtcgtgaaagcacggcaaaacccactaacatcactcatc

SEQ ID NO: 1926 - DNA, 455 bp, Phlebiopsis gigantea mycovirus dsRNA 1
  complete genome.2
gccccttcttcgtaggcagtaaacctaatactgcctctaagttctctgtgtccggacgcgcggctgtaaaccgcgacgctgacctcgatatcctgctggcgggatgtcgtgcaacaaaaaattcaaaaatatggacggaagcggtcctgaggagacgtcacgaaacggctggtccgtcggccgcgagtgcagctgggctgtgcaatcaacaactgctggtggatagtaccccgaacccccctattagtgatgctggacccaccggtgctggcccaagagctaagctttctgcgcgagcttctcgtttgcgcgtctgcgaccccacggttggcgccaccgggaccggcggaacgaacggtgtgcacggttccctctgtccacctgttaccgcgggcgttccttgtacggaacggcctgtattcaaagccacccctgccatatcgcaggctccgtcc

SEQ ID NO: 1927 - DNA, 455 bp, Robinvale bee virus 1
  isolate VN1-10 nonstructural polyprotein and1
ctacccgcatttatgtaggctctaagagttaccttatgattggacacagtttatgagtgatttggactctttccgaatttgatatattttaaaattcttacaatttagagagaatacgaacgcgatggaccttgagaaaatcttagctagtaattgaatctttattgcgtaagaatgagatgaacggaaccttaccaatcccaacccaaatatggaggagctattgcctctttcctgagggcggaaatcagtattaaccgacgtaaacccaaacccaaacccaaaccgaaaccgctaacctgaactctgcactactctacttggaacgcaaaggaaaaatttcactagaccaatgctgttcacgacattgtgaacgcccatattttgtttatcgatttggaagacaagctgtcatcaaaacacttgatgagtgcattcttacggtcgacactccc

SEQ ID NO: 1928 - DNA, 455 bp, Wenzhou tombus-like virus 6
  strain WZFSL85189 hypothetical protein1
acgggctctgcactgcgcctggttttaaatctcctttctgtattttgggagtaccaggtatcagtgtaacggcgggagcccgattacgtaaggatagtagtaatattaggtatttaacacaaaccagcctaggactaccattccaagcccctgaagcaagcctacacaatgcgctcgttgcgatagaacgccgggttttcacagtaggaaagggctccgagataatcctcccaccacaagcacaacatggtatttttgaggaactcggctacttcagagatgaggtagtacgtcattcggggtattgtaggaaattcagcgaggtcgagctcgccaattcgtaccattctggcaaaagatcccagtactacaaagcaattgcttcattaaagactcgtccatacgaagaaaaggatagctttgtcacagcatttatcaaaaaagaaaagcactgg

SEQ ID NO: 1929 - DNA, 456 bp, Hubei coleoptera virus 3
  strain QCM109726 putative glycoprotein,1
cctacttctttatgggctattttaaaacttgagttggactaatatattttcataatgtctaatgatagggttgagtctctccatcagatcagaaacaaatctttgccaagccaaaaatacaagactccagataaaaaaccagacttagatgttgacaagcgtttggcaatcattgagtcgaagttagattctgccttggctctaatcagacaattagtccaacttaaaaatgctgaagcttcaaataataatactgttaaatcttctgcacctcctatgtatccccatcttcctcacaccacccagcctagctatgttactgcattccaattgcccaagccttattaggttagcataaaaagtttaataaaaatggctgtaaattagctattttaaaagtaatatcgcttttaccctctttattaccaaaccagctatttttcagctatctcaatc

SEQ ID NO: 1930 - DNA, 456 bp, Solenopsis invicta virus 4
  isolate Gainesville-Sin, complete1
cagcctctgaagcttttgaagctgaagaaggtattgaaagcggagttaaagttggtgagtcatttggaggaccattaggaatcggtgcaatcattcttcaatcattaggtgatgtaacaacaaacgcactaactgctggaatgaaagagactcaagctagcgattatacacagaatgcaacgcaacaaggaattggagcacagttgcaagctggtttaattgaaaagaatgaaactgccactattgatcaagtatctgctgtttctaaaggatttgatcttttgggacctgctggtgctggaattggttatgcaattggacaagcggcttttcaacctggagatccttatttgaatacagtcaactcctttaatggaatgacgaaccctcaagacactggaattgtacagtcactgaatactgatagtgcaagcggtgcaacacaacaagtagaaa

SEQ ID NO: 1931 - DNA, 456 bp, Trichosanthes kirilowii picorna-like virus
  strain pt111-pic-61
actatatgtaagggagaaagccgtggctgattcgctagaactttgttcaataggactgttcttttacgttttgtaacgtagtggaggttaggtccgcaaatgaaagctgcctttggaaatatagtaatgtaaacctttatagaagtataaagtggaggtctttatcgaactcttgttcattctcctcccattctcacatgttagtgggaaataatttaaaatggatttttctgtttgaagtttgagaaactaataatagaagtagcaactaccaccgaggtggaaaaacgtcattgagttgtgcgaaagttgtatttcgatgatttagaggtctatcaaatgaatggcagattttgaagtttcaaattactttgtgtttggaactctgttattaacataaagcgtcgaattggagacgttaaatcgaactttttcttattatttaaaccaatcaat

SEQ ID NO: 1932 - DNA, 457 bp, Partitiviridae sp.
  isolate H4_Bulk_46_scaffold_395 RNA-dependent1R
taattatacataagttctccttgttttaaataaattatatttaaaactaaatatattagttggtgttcatgtgagactcaaagaagcattaaagaagtttgacttcgtcaaacgtcttaaaatacctgagaagctatatcctacgatagtagctaatttagctgccgtacttaagggctcagacaataagtacattacacctttgggtaaaacacacgatcctatcgaattaatcgtagcttgggatgaagtattccaagctaatgcacataaactaaacgctcctttactagacattgaagcagagcaacggcgcaagtttggacctcgttcaagggctaagccatgggttgaaagaaaaccaggtttattagcctcatttcatagtcagattgataattttacgccacctttcttcaaattcgaagatggtgaacataatttatgtcctctttct

SEQ ID NO: 1933 - DNA, 457 bp, Trichosanthes kirilowii picorna-like virus
  strain pt111-pil-51
tccaaaacttatggtttggatttaggcaagttttacttgtgctttcttgatcttgtttttggcattactaggttaatagtgtattgatttagtttttatatttcaggtagttaggcgagatgctctactagcagtcctaccgtttacaagtatagaaatgatagttggttacttttagcttttagtacttagatggatgaaagatgtgtagcatattttagtatgatttatgatacacttaagttattgaaaagtaaatcttgggttccaccagtttctttgattaaataccatcggcaaaattcttagctcattaatctttcttcctgaagttcagttttaactgagcgtaacagagattgtatttaatgcaacattagtaagattttggcctgtatttgttagagaactacagcgaataaaattcctaagtgttttctttaatgacatcaggaag

SEQ ID NO: 1934 - DNA, 457 bp, Beihai picorna-like virus 69
  strain HOU158647 hypothetical protein1
aaaggatggaagattgaaaaactggaactgtatttagtgaaagagaacaactgaaaaggttgcagttttaaaccaaaatgatctcagttatgagagaaattcggtattaaatctatcacccattttcctgattgaccctagttggtgtcaactgtaatttgttttgtttatttgttgttttatgtgttaatgttactaagtttttgtgaatatgatgggaaagcaaccgctctaactccaggagatgtacctgcccgagggtaagggaacctttgtaacggttttagatgttagtaagtactatagttcacgaagattgagtatactgcgctggagtggggatggcagcgcttaattaattatcttcccccggatggcagtccgttagccactatgtggtagccgatgctttggcaaggcatcgacataccctagtacgcaatgccagtatgagtgt

SEQ ID NO: 1935 - DNA, 458 bp, Marmot picobirnavirus
  clone c329629_g1_i1_libraryA_2570 segment I1
tctttacatctatattatctttaattctttattctattccaaacaaatgttctaattcgttctctagtaaagaaatggacaagtacgtccttggagaacactaattggaacaaattacaaagaagtcttgaagcaattagtcctaggagattagtgtaggacggaaactttacttcaagcaaataacatccagaaaggagggtgatttgacacagaatcagatcaactaccaaagaacgctagaagataggcgttcacatcttgcgaacgagaaagagacgaaccgagctaacactgctcgggaaacagaagaacatcggtccaacgtagcgcgcgaatatgagaccaatcgatctaacgtcgcaagagagacagagactcatagagcaaatttggttcaagaaaatttgacgtctcgtagagaccaggaaacgcgtagatctaatctagcgcgggaa

SEQ ID NO: 1936 - DNA, 458 bp, Wuhan house centipede virus 1
  01BaA1 genes for replicase,2
cttccggttgccgacgcttccctcagttataaagattatcttaacgaaaaaatttttctcgctcctcctcaacctcctataagaaatcaaacctcggtctctccggccttaagtactactactgccgttagtgtcccgactacaacacccgagatcgttactacatctcgtccgataccatctactactagaaagtcgagaccagtccctccatcttccattcctccatacatcgattgcggatgtctcgaaccacatcagtgcggtcctcctttaggcctccctcagaatgaccctcgtatgtctcgtgattaccctagggtttattcacctaactgcaattggtctgatggaaaacctcaggacacctatataagacctcctgacactcgcaatcgtcatcaaaatcaacgatcccgcaatatttaatttgaatataatttatcaattctataaaa

SEQ ID NO: 1937 - DNA, 458 bp, Wenling narna-like virus 8
  strain WLJQ103992 RNA-dependent RNA1R
gtgtcatctgcgtgggcagaagatcttgtccacccaagtgcgaccgcaaggtcgcgcctggccgatccagggagccaaagcacgaagccctcccgtgcgggcccgggggcagagaaataacatctctctgtcagccgggactcgtattcggagagcaagcgctgaacgctcccgctagcgggaacaagggacaccgaagggagacgacccccaggcacgcccttattcgcctcaagtccgcggaacatcttgcggactctcacggcgatctggcggggggcaacccggaactcgtcgcggggctggcgctcaggtcccaggagcattctgagctcccgggccatacgagtcgtcagttgctcgacacagtccactgtgccgagctcagagcctttgccctcgaaggggactttccccctcttgcaggcaacggcgctgaccgcgagcttgtgccgggt

SEQ ID NO: 1938 - DNA, 459 bp, Colletotrichum eremochloae totivirus 1
  strain CeTv1CBS 129661,1
caaactcacaatttgggggactctgccacaccgtggatgacggcctagattgcgccgttattgacgtcgtgtatggcgttgttgtcgtcccatgcccggccggcccccccctccactcttcggtggtgtgcggtgccgcccggcgtggccggttcatccccatatacgcttcgtcaatgacgagcgccatcgtggccggctcacatcctgggcagggggtccgtcgccgctcgactcttgttgacaaagcggcaaaccgcagcgcagcggttgtgacgtcattttgcgcgcagaaccttggggtgcgcacccataggccataccatccgaacagggtggctccctggctgaaaagtggttctttggtacacggagtagggagggctacggcctccgttgatcccgtgtgtcaacgaattatctgctcgcaatcttcaccttgtttaccccccccaagcc

SEQ ID NO: 1939 - DNA, 460 bp, Chinese broad-headed pond turtle arterivirus
  strain WHWGC150683 1ab1
gtggaaaccccgcggatatctctgaggcggcagcctgtgtacaggtactgccgacccttctatagcgactccaaactcgacccgcccctagcctgacaacgtcaggaaggcaagccttgaaaagcctccgtaaccgtccaacggaggtggtcgtgctttgcagcgctcgttcttagtcagcgacccaaactcagttgaccatcgtttcagactcgagagggcgtgccctcatctgactcgacttctgagatctagctgacggtctgtgaccttcatcaacggaccattattttctacttagttgctcaccaggctaaacgcgagtgttctcgcgcactaagtatacttaaaatcctatttgctctgacgttatagagcttaggttcagtgttttatacactgatctccatcaatctccacgacatctcagtgttgtctcctgtgatcctaactactggta

SEQ ID NO: 1940 - DNA, 461 bp, Marburg marburgvirus
  isolate Marburg3
aatgatgctcaaataaaacagaagtccatctgtataaggagtatggcttaaatgggtatttgtcagattcttaagagattagtttgtattgatttaaataatgctttaaccttacattgctgctttaaatggttgattaagctgattagcttgtaatatataatctcttctgggccatcagatctgtaatgggtttactagattatatacaagacacagtaatattttataaacaattcttgctcagttttgctttgatttaataacatacatcattgtgcctttcattgctaggtcaacccaactgataatgatattccttctgaaatagtaagaaaaactaatgaagaacattaattactgggtaaaagtgattaagttctttaaatttgatcaaagtaatattttgtcagtgaatatattctcatatcacttgattaaaaacaggaaattatcctaac

SEQ ID NO: 1941 - DNA, 461 bp, Plasmopara viticola lesion associated dicistro-like virus 1
  isolate1
gcaaggtttatctcttcggagtttttacttgtatcggagacagttctggaccattcctgcggaattcgctaatgatcgtgaataacaccaacggaaaagtttgtatctctactgtagaaatctccaaccccaaaccccaacccccaattttaaactcatggacgaaggagtataactttcccaaactcatagtattgagtataactatactagtcagtaaaagactttaatccgacacacgtagtgtcgttaaatgaattctatttgtatcaaatagtcttatctccccgtaaccaacacgaaaatattgaacgtttcgtactaagttacatggatgtgatcttgctagattatactgacgacaaattctagtaatgctatccaactacaagagccctatttagggatggcctcttcgcagcagccctgcaaactgccactcgtcaacctgcttcgactct

SEQ ID NO: 1942 - DNA, 461 bp, Picornavirales sp.
  isolate rfb094shi2 genomic sequence.1
catcatggaattttggagctatcaccgataggcttaaaaattgggtgaaaagtatgagtaaagactgcattcagttttttattgattctccattcgtggctggactcctttctattattgctggaattgctcaattccttggattgtatatggttatgcctactacaagaactggaattgctgcccttgttgataagtttcagaactcaacaagaaccatgcattatgcgaggaatgggttcaaaggagtaatggattcggtaaaggactgttttgcatgttgtaaggacatgttgggcatttcaaataatgcggaacttgaaaagtttaaagaacaggtcacccaatcattggagctttgtcgtgatatgttaataacagcacagtcaaaaccaggaacatttgtaaatgattcacagagatatgtcggatgcagaaaaagagtataggagacgtcatct

SEQ ID NO: 1943 - DNA, 461 bp, Sanxia picorna-like virus 11
  strain SXXX37695 hypothetical protein1
cgtgtatattgtatagtatatgcgtaaaatttatttgcccgacttacgacggatttcgtttgacgagcaggagcgttgacttctgcacaaagtatgatacaaaagttagagtattcacgccttactattatagtgacgcttcatttatttttattttcatattatttcgttaaactttttcgttaaaagttaatttatatagtatagagagctggacttacattgtcttcgcttttatgcgtgcttagttagagctggattgctcacgacgtatgtgtttaagttgagattgtgtgtgaaattttcagtagctttatatagggggatatcaaacctccaacccaattagaatttgcgcttttaattggcacttgaaagtagtgatgtaagcaaataaccttgtgtgggatggctcccacacattgtatggcccgtcggcattgccgtcaatcgtaacacct

SEQ ID NO: 1944 - DNA, 461 bp, Hubei polero-like virus 1
  strain WHCC118254 hypothetical protein 1,1
aatccttgcggctacaagccgcgagatggctggaccgcgcccagcatgctaaaatcccctcgactgaggagcgggagcgcgtgattgctaagaccgtgagggcgttctcaaacgcacaaacaaatggccccacggcaaccagagatggacggctgacctggagaaactttctccaggatttcaaaagtgcagtgttctccctggagtttgacgccggcatcggcgtcccgtacatcgcgtacggtaagcctacccacagggggtggattgaagatccacgacttctcccagtgttagctcgcctggttttcgaccgattacagaagttgtcggaaattaggtttgaagatctttccgctgaggagctagtccaggctggactctgtgatcccattcgactatttgtcaagggggaaccacacaaacaagccaaactcgatgaggggcgctaccgcctcatc

SEQ ID NO: 1945 - DNA, 462 bp, Wenzhou picorna-like virus 17
  strain WZSBei69283 hypothetical1
ggtgaatccccccctcttcctctaacgtctattagcaggtagatgtgtcttctcttattttgaagatgaacatactgtggattctcgagtgtattgtggctacacaatatagctcaaagagctttttagcgagtgtgtattcgctagattgcacactcaaactattaagttctggatttggtgactatttcagaacatttctttgttcgtatgtattatatgtaatatattctgaatttaaggttgcactttggtggttcgtcctacgcaggaatcaccatgcaaattcaaaagttttgtcattccctatacttcgggcaaaacttcaacaatattttattgttaattatagggcggtctagtatcaatcgttatatgacctaaatatgtagtatgcacgccactacgtatttagtattttaagtgcagcacctagctcaaggttatgagcccttatataaa

SEQ ID NO: 1946 - DNA, 462 bp, Hubei dimarhabdovirus virus 4
  strain SCM46012 RNA-dependent RNA1
tgggaaatgaagatggtgtgtatttatttatttatttattaagttaatgtttaatattccaagttctatatttgtttaactgtgtgcgtttccttagatattgatctactctcttttaactttatctcagttgttcttgacaacttcattaagttgatccgagtcctgtcatatagtcaatcgtatgggaagtaccaatacccttcttaatcccaacgagtgagatgacaataacagcatttggcgttccatgctgttttagcaggaatgtcttattgactcgggaatatttacttggtaattgatgtgataaactggtcaagtgcctgcgataatgacacacgtatacaatcaaaatgaggcctaaatacggcttttaattggtgctatgcttcgaagcaatgatacaatgatataacattacatcaaattagatcctgaaaaaaactaacagacctaaag

SEQ ID NO: 1947 - DNA, 463 bp, Beihai picorna-like virus 11
  strain BHZY60905 hypothetical protein2
ttcatattgcataccgaccgtcatgtctttaaactgtccggaggcgctgcggtagtgtcgtcgttactagaatgaaaccaaagccgaactcaacattgattacagatgttatgtatggtctagcacataccatgcaagcagactgctttgttgagacaagaatgacgcgaacatgcgagtaggtatttacttacagtggtttatagccccacaaacaaaggtgtgaataggcagacacaatgatgcatgtgtctgacccgtatcaacaaatcgcattagtaattttacaaattttattacagagccaacgatctctataaaccgtacactatacaaaccccagtccggtgcactgggtactattcaagaagaaggtgttgcaaatcttacggcacaaatcactaactttgaggagcaagatgctggttggaccacatctattggcgcaggttgggattctacg

SEQ ID NO: 1948 - DNA, 464 bp, Hibiscus green spot virus 2
  isolate WAI 1-1 segment RNA3, complete1
cataaaattcaaacaattctactgaggtgatcccttggtagtcttattttgtccggcgacgaggggtttggccgttatcaccctagacgctgtagtcatcaggtactggcacctgtactggagaggggctgcacgttgccatgctcggtgtggacgcgagatagtgctatcgcatccgagagctggtgtcctggggactgcctggggcgtagctacactattatatatatatgttggatcgatctgaggcaaaagtccactgcttttcattatatacgtttggactaccggttagcgggtggtacgattagggacgcctgataacctttcgtatctgtcagtgtgataatagtgctttagggtaagtggtgccgacttgtcggttttggtcgtggtcatttggcctggatgtgtttaggtaaggttgtgtattggttgttgcatcttgtctttgggacctcgaa

SEQ ID NO: 1949 - DNA, 464 bp, Wenling fish picornavirus 1
  strain XYHYC180303 polyprotein gene,1
gggggaccatcgacttatactcgatgctttccccctctccttttcaacgtcctgggcacgatacgcccaaccctactaatcaagcttgctagatttgctggtaagacccgtttggtaacgtaattacccgtaacgaatctaagaggtttggctggacttagtacctattaagatatgccttccggttatgtctcgagctctgctgtggaacaacacttggtaacaagtgccccagcagttagtgatctatccggttgaaacagtcttattgtgggaacagtttaagtattccgattacattcggcgtgaccttacgcagtgcacggacggatagtaccctcctttaggatcgaatccgttctttaggcccctcttggcatcctagcgagtcacctctccgtgacaagatagtgctgtattggcaaatattttcactttttaccaaaaactttcatgatgacaaa

SEQ ID NO: 1950 - DNA, 464 bp, Wenzhou picorna-like virus 5
  strain BHZC35527 hypothetical protein2
gtgccttaaacctattcacccagttttgagtctgggctctacggaaaagcaaaacttcatgtgtatatatggataccaattctcgcacaaattttgtgtacttttatgtgttagaattaggctttgtacataaagacaatctgcctgcggattacccctatttaggggagagtttcgtctactcaatgtaaactacaccactcctagcactaagcaatgcctggagattgtaaataccgcttactaataatgtaaataataataataataatatatatacatcgggtattacgtacccaacaatttttgaaattttgtcagacctcaggaaatacaaaattaatccaaaccgttttgataaactatggcataaacatagatgggaattagggaaaactgtttcatcatttgatggagtggagattcctcctaaaagagtgaaccaacgcctagttaaccaggtt

SEQ ID NO: 1951 - DNA, 465 bp, Wenzhou picorna-like virus 31
  strain WZFSL72092 hypothetical1
gtgttagttcactagggttttatattaccgtagtccatgccgcgttagtgctgggcgttttgtgccatgaaacggtacttagtttgcgtttgttttgagagtgtgagctgagtgaaaatatttattctttgatgatatatacgtacgaagtactatttaagtatgtgtatagcttcgggttggcaatatacccgttacttattgattggccgatatttttaagcggttggagtaaattgcatcgcatcatgtaaacaagaaaatgttcctgtttttgtggtatttcaccgtaagactcagtgttgagcagggtcatatcatatttacagtgtttgaattattgtagatggtggcatgcatttgtagccaattgtcggttcgttattgaacccccaagcttgcgatggtagtagcaagttgagccgggataggccggtggttacactatcaaacaactcagcagtg

SEQ ID NO: 1952 - DNA, 466 bp, Leucocoprinus gammaflexivirus E
  isolate Won, partial genome.1
cccccccttcgtaaaaatttgcggcaattacctccaagctcgaccacacgaacgagctttcacgttcgtgacttatactgattccctccgaggtcacatcaaatctcaacttaaaactttcggtgacgtggagggacatcacatcaagacgtgggaactggctctgctccaaccatgcaacccaatcgtcatctttgacgacgttggtctagctcctcctttgttggacttattccttatcacccaccccaacgttaaacactttttctttaccggagaccccgcccaaccccaatacaacgcctacaagcgcttccctaatgccccctttgtacccgataaccttaccattctcgctcaatcagcttgtcgttacttccgagaaactcgccgggtcccaatcgctactgcttccgctcttgggctaaacacctcatccaccgctgagggtggccttggactctcc

SEQ ID NO: 1953 - DNA, 466 bp, Hainan oriental leaf-toed gecko picornavirus
  strain LPXYC2131221
gccacacgggggtttaattactcccgtgtggttcgctttggacagggtttttgctatgccctggggaatttcttcccgaaatagccttctgcagttcagagtagtagctggactgtgggagttcttttctttctttttcttactttatgtttgtttgtttaaggtttgatataatggttttatgtaatgtagtagccagtacgctggtgagcctacgtcaagattttattagagggccgtcctgtcctcgaatgttattgatgggtatgtcaggtgggttaaaccatttggcgggcagtcactggctaaagggcgtactagtgattctacttgtgcatgacatgatggttctgtaagtcgcagagtggagtacggacctggatgatgctgctgaccagtggggccttatcccctgccgtttttacgcaattggcggtatgggtggtagttgcagtagctcagtatt

SEQ ID NO: 1954 - DNA, 466 bp, Blacklegged tick picorna-like virus 2
  isolate RTS-11.2 hypothetical1
ggggtgtcgctgtgtgacaaaacaaccacttttttctgacttaaagctacgaaagcagcatcgaacaaagtcttagacaaagtgccaagtgctccatgtagctttaagtcagaaaaaagtggttgttttgtcacacagcgacaccccgcatgataccagtcagttcggaattcaattcttccaggatagtgtgcaggtgcatccaaaaagcgccgtgcgccatttaccagcggaaatttcacctgtgtgcaaagtttatggagtagtgggtaatcaatccacggcctattctacagtggtgacgtcacccatttctgatgcggtcgagagacactgtggtattgaacagcgttggggtcctccgaaatttcgcagtaattacccatggcaagcgagtttacagttttcatcccaacctactttaggcttacctgccgaagatttaatttatgcggtagattcctac

SEQ ID NO: 1955 - DNA, 467 bp, Wenling crossorhombus picornavirus
  strain XDXMC21480 polyprotein1
cgcggttaaacccgcgcaaccttctttcagccgcgtctgagtagcgcggttagtcctgatacacagtttcctgttgggtactgtgtcttcgggtgaatgctcttgtgtgaatgttttaggctgtttaagggaagcgtttccccgtgcgctgtgagggtttctcacgctctttcggggtgcagtctcttctgttgttcattaagatgtatggatgcactgttgtgaaggatttgtgaactggggatcgacaccccgtgaggggtgccccagtgtccataggagtttgctggagaggtgtgttgctgtagtgactatccgtgacctggcattctaaggtgttgaccccaacctgtgagggtctggatcgcagtgttgaagtgctttggagggttcaatggggtttctgtagtggatattatgtgcttgacgactactggtacgagtgtattgggggtctacatgtgtga

SEQ ID NO: 1956 - DNA, 467 bp, Picornavirales sp.
  isolate bpk205shi03 genomic sequence.1
gatgagccaaattacattacgttgtgttgctgttacggctaatggcgcaaaattcgcaaacctcgctaatccagcggagtctgttacttttaaaaccactaaccaacagcgttcacgcaatggtgtacaagccgttgtcggtcgctcttcaatcgtttggattgcaccgcacgtcgtaaaacaatgcgatgatgcttgcgctccgtcgggtgatttcaccgacttgctacgtctcgaattttctaatgcgaattcaggggaacagttgattacccgccttaatgatttggcggactggttaactgcacacccggaattccttcgaggctttggtccacagcaatcttctgacgttgttcttggaacagtatgaatattcaggtaatgttattaggtagccttgcgattatcgcaactaccatcataacggtaacaggaatcgtttcttactacatccactaacttgc

SEQ ID NO: 1957 - DNA, 467 bp, Hubei yanvirus-like virus 1
  strain WHCC105213 hypothetical protein1
gttttgccagaatgccaactgatcggaagagaaaatggcaaagtacccctttgggtggcacctcaggtgcaatggctggtcaccggcctttgtgcatacgtgccaacagggttgtgggggcggatgcgggttgtctctggcctgtcatcactgatcccactccaaccgatgggtccaattcttttgggcactactccttcctctggctttgtctggccgcgcccttctgggtgcaaacggagtttggtttgaatcgggttcctgtgtgtcgtacacacccactgagtcagacggcaccgcgccgtactgatatatcttgagggccgataggggttggcctgtcctccaggatggcttcctctgagtcattattggtgaggcaagtagtttctgctgtgcgtgcttcagtgctgcctgcatatacccatctcattcaattctgatgttgaggataatgcctaatctgg

SEQ ID NO: 1958 - DNA, 468 bp, Plasmopara viticola lesion associated narnavirus 25
  isolate1
gatgtcttgtatcaccggacggtagaactaccttccagtgcttgtggtgctagcgtgactgaaatcacggtcaccaagtatctcgagcgcaagtcgattgggaacgaacctcccctctctgtcaagcttctccgcccaccacgtctccaccgaagtgagaggcgtgtgtttggaaaactggcggacagaaggaggggggagtttcaacttcccaggtttcatggtctttggtttgcacggacgatattttcctcccgttgcccagtagcctttgtgcgctcctgtggagacgtacttgcctactgcgcgattggagacaaacgtaagtccaggtggtggagcttcactaacgagggcaggacccccgatgcgaagtcgcacctccacctccttacgcatgccttcgaaccgccgcgggtcggcgggcgcgaagaaaatatcgatacgtgcacagtactttgttgggtc

SEQ ID NO: 1959 - DNA, 469 bp, Sclerotinia sclerotiorum hypovirus 2
  strain SsHv2.HBstr-470,1
ttttggggatggtgctcttaggtttgatctttgtagatcctaactaggaggaaacattgccctgtttcgtgatgatttctatgttcaatcactgaagcttctcttcaccaaaaaggagagagcttcgagagcttagctgtttcagctatttgaaccccgaaggattcatgtctaagacatttggtttctattcagaaactattcattctttcatccgaagatgtaaaactacttcgtagtaacgagacggtcctgaaccctgacatgtggaacggcgacgacaggcattctgtggagtagtgtcctagaagaatgatcccctgttgttacctgtcagactggccccggcacaccgtgatgcccggtgaactggtccgtgagacccagatcggaatactccaggctcttttgcacgatatgcttgtcatttttcgtggattaccctggtgctcgttcccaatccgaaagt

SEQ ID NO: 1960 - DNA, 469 bp, Unknown
  Description of Unknown: Mutant Zaire ebolavirusisolate Ebola1 sequence
cggacacacaaaaagaaagaagaatttttaggatcttttgtgtgcgaataactatgaggaagattaataattttcctctcattgaaatttatatcggaatttaaattgaaattgttactgtaatcacacctggtttgtttcagagccacatcacaaagatagagaacaacctaggtctccgaagggagcaagggcatcagtgtgctcagttgaaaatcccttgtcaacacctaggtcttatcacatcacaagttccacctcagactctgcagggtgatccaacaaccttaatagaaacattattgttaaaggacagcattagttcacagtcaaacaagcaagattgagaattaaccttggttttgaacttgaacacttaggggattgaagattcaacaaccctaaagcttggggtaaaacattggaaatagttaaaagacaaattgctcggaatcacaaaattccgagt

SEQ ID NO: 1961 - DNA, 469 bp, Ginkgo biloba picorna-like virus
  strain pt112-pil-2-NY genomic1
gttttattcttctgtgttgtgagacgtgaatacgagcaacgggtgctatgtaggagtacatagcataccaccgtaagtagatagcgaaatgacaatttcttataacatagtgacaatttgatgtatcacacagtatttagaacacactaatattgtggtttactgttctctcagtagtccgtgtatgtgttaagtataaggtggagataagaaacaatagcattccgttgaatgacaaaggcatgtggccactattgtgttcttacttatatatgatttaatggattaatggataacttgagtgttgtactttggtattacgctcaattggtctcggaagactcgtttttgagctccacgtgagaacgtgactggtcagccgccagcacgatatcgccattaaaaatggtagagagctctattggttacagacaaaatttctgaggtttctgctccgttgatagcagat

SEQ ID NO: 1962 - DNA, 469 bp, Hubei permutotetra-like virus 1
  strain WZFSL84790 RdRp and1
gttcctctcctctctacctgacccggaccacgaggcggctaagctgttgttgggccgaggagtaaagagcttggacgtgaaggatcaaagtattgatctttcatgtctaaacgtgtataaagagtcatgcccaatcagtactctacaatacgaaaaggctcaaatacatccagaggccacgaaccaaaaagacggaaaagtaaccgtacgacgtaactttggtagagtaggcgcacaggacgctttgttgtcctctgcagcgctagtaaaatacccattagaaacgttggaagaactgcgcgacgcaaccgtatatacgtcaggaactccctctggtttttcaaatcgaatcaaggagcttacaacacggacgtgcaagtcggaaggaaaacccgcctggatagccaaaaacttatctaagttgctaccaacaacagaacttcctgattggcatgatgttgaggggttg

SEQ ID NO: 1963 - DNA, 470 bp, Wuhan nido-like virus 1
  strain SCM49454 1ab, hypothetical protein,1
atacttttagacgttatctaattattctgacatttcaggatagcttacgtacagaacaattagataacgtctaaaagtattggctattaacgccctattatatacacaaatttaataacggaactgaaattgaaacaacccgtatagcaagagagatttttaaaaatttagatttcaagcacttaggtgcattctttttgctatatagaccataccgataaaacacacccaaccccggggatttccccttttttgcaaagtatttatagctaaactaaagcagaggttcagatatctacttgaatctttgtagcagtggttatatttgcttattttttgccttcgggccattctaaactaagttttatcgaagttcctaacttggaggtgtcacttaggaagaatcaacaactaaaaaaggtcacatacacacattggaagattcaaagcttaatatctacttagccaag

SEQ ID NO: 1964 - DNA, 471 bp, Beihai picorna-like virus 115
  strain BHHK131520 hypothetical1
gtggggagctaccactccccaccgcttgtttacctgctagtacattttatgacggtctaaccgccattctttgtatccctcttactgatcatttgagggctctattgtacccaacagacaagaccgagtagcaagattaaacttttatttctataactatatttcccattacttagtattaaggatttttgggtatttatgtagaaatgcctagtcacgacatgacttaaaataaatagttaggactcgacatcctatactatgtcaccccttttcggtcccgccgtaagaggcttaggcccctgatggggattctgtgtaattgcgaattacagatgggtttaaaacgtagattggagaacactctccatgtagacggccccattagtttttcgtgcctgaatgtgagtcggcgccaccacagacccctgatactgccgtgacaagccctgcagggattcctcatataac

SEQ ID NO: 1965 - DNA, 471 bp, Beihai picorna-like virus 28
  strain BHZY60695 hypothetical protein2
cttatggcatcgtgctgaaatcacggtaaacttactccgttttgggaagaacgttaagctttttgatcttggaccgatgttaaaggtatcccgtcccggaaagacgttaaacttgctaagtcagttgtcctctgattagtgcccacgggcaataggacttgtatataaaagtgattatagcacagagttgattatttttcgttttgttccactctgtagtaccctatgtatataaataataaaacctacgtgtagtataccgtatgacttgaaagtatttgcacgttaaacgtagtataagtcaagaaatgtatatataatgatactgatgatggacagttaaaaccatcacttttacatattttcttttccgattcggctgaaactggtgaccaacctgttactgccaacgcggaaacagaacaagttttaacccagattggaggagatgccccacaagaaaatgagggc

SEQ ID NO: 1966 - DNA, 471 bp, Changjiang picorna-like virus 8
  strain CJLX30776 hypothetical2
gactggacttgctggggaaatacctagtgcaacccagcattttaccatcgctagccactactcaggactatccagagaggcactagacgcgtggttgttgagtttgacccacgcagtaatttaagactcgctaaaattttagaatccatagtagaagagaaagtttgtgcagagattgaaggtctttccgtgaatgcacccgatgaaacaacgggtgttactagttttgcttcggaagccggggtgtgtgccgatatccctatagaccctgttgtctcattcgccaaaggcgatgagtcttaccaggatctaaaggaatattttaggcgcccccggcttattttcaccggcacttgtgctaacactgtttccgttttggtaaactccaacgttagtcagatttcactttttcaggattggtttccgaatggtatagaacgactatcaggagttcaaggggttcgcttcgat

SEQ ID NO: 1967 - DNA, 472 bp, Bat badicivirus 1
  clone Bat/CAM/BadV-P11/2013 structural2
tcatgaactcattaattcacttaatcacaaaacttgttgaacaattagaacttcgtggttgggtttgaggtgtttaaacatggatcatgtagtaccttatctacaaatcccagttgttggtctaatccttttaaagtaatggcccggaaacaatgtagggagtagtgaggatctgtgagtaagacgtgctctggcaagccgcgggtctccaattctggactttcggaccccagaaaaggaagtcgatggcccccatcacagtgagcagtaatacatgtgaagtggacaagttccattgaaaatcattcactcattggtttgtggcaagttgtgtggcaacgaggatcaagttgtttggcaacggcaagctgtgcggcagcgtggggaatggcaagctgtgtggcagcgtggggtaaggcaagctatgcggtagcgtgcaagggcgcgaaagctctgaggagcgattctgaac

SEQ ID NO: 1968 - DNA, 472 bp, Hepacivirus C
  strain SL7 polyprotein (POLY) gene, complete cds.1
gctagtgatctcgcgggggcacgcccaaatttctgggtattgagcgggttgttccaagaaaggacccggtcaccccagcgattccggtgtactcaccggttccgcagaccactatggctctcccgggaggggggggtcctggaggctgcacgacactccaccatgaatcactcccctgtgaggaacttctgtcttcacgcggaaagcgtctagccatggcgttagtacgagtgtcgtgcagcctccaggaccccccctcccgggagagccatagtggtctgcggaaccggtgagtacaccggaatcgctggggtgaccgggtcctttcttggaacaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcatc

SEQ ID NO: 1969 - DNA, 473 bp, Marmot picobirnavirus
  clone c207250_g1_i1_libraryC_2509 segment I1
atcaattaattctttaatttcattcaatttccaaactaaagttctgatctagttctcaaagtaaagaaatggacaagtacgtccttggagaacatcgattggaacaaattacaaacaagtctcaatatgcacgtctgaggagatcgatgtaggacggaaaagcatagtttgagcaaataacatccagaaaggaggtagatttgacacagaatcaaatcaactaccaaagaacgctggaagataggcgttcacatcttgcatccgagaaagaaactaatcgtgcaaatctagcgcgcgaaagagaggaaaaccgctctaatctggctcgggaatatgagactaacaggtctaatgttgcaagagaagttgaggcacaccgctctaacgtatcacaagagcatcttattgcagctagagatcaagagacgcgaaggtcgaatttagctagagagattgaaaccaatcgctcaaac

SEQ ID NO: 1970 - DNA, 473 bp, Perina nuda virus
  complete genome.1
ttttaaatatcgggtacagggttttaaccctgtacccggtattcagaccttagcttttgagctattgtaagaaggtagcctagcttttaagcaatggcggtattagatcttgcttttgagctctatctagtacgtgtttacaattaattcgattagttaagattttaattagttttagtaaccagtgcttcaatcttctattgtggcactggcttggatctcccttacacatgtgattacatgatagacttattagtagtagatacatctaaattctacaacgacctagtaagtattagttatgtgaaatagaatgtggaggattttaaattgtgaataggcctttatattcggagtaggtagtattgcgtatactattaatcccacaatacgtggtctccgtcttagtatttttaatttgcgccccaatggaaatggctcttcggacttgagtacagaggggcaacccataa

SEQ ID NO: 1971 - DNA, 473 bp, Wenling brown-lined puffer picornavirus
  strain XTXMC521401
ggggacagttaacatagctaatgctagttgacatgtccctaaacccttttcaacgtctgacccacgatacgggtcacctctttatgtttgttttgttttacgtttgtttgtttgtttggtggaacgtaaccacccgtaactataactagaatgtaggctacttaaattaggtttgttttacggatagttctcgtagacctcgagctacgtctcgtgcataaacatgggtaaccatggcacttggcggttagtggtttttacttggctttcacgaactcaaattgaaataagtcagtgacatttgaccttgtaggcgtgaggcgatgtgcaccgcgatatcaggtaaccttctttaggtctgagatgttgtcccagccacaatctttgcgagctggtcgagggctttcccgaggtactgcacttaacccaaaactttctaaatcaaactcaaactattgcagacaaaattaata

SEQ ID NO: 1972 - DNA, 474 bp, Aphis glycines virus 1
  isolate North Dakota, complete genome.2
gaatttcattttataggaacattttcacctcatagcaacactcccattgttatgttgtacccctcccctttcataattgccttcctagtttatcttgtgcagtttttatcccagaagattgcattgacctgctgtgtaacaggtgttgcatggtaatgactactaggtgtccatattcacggctcgagggccacagggtgaaaatccctacattctagtgtgaagcgaaagataagctggaaattgagagaaagctattcaaggatagtgtcgtgcagctcttaggagtaaaggtgagtaacgtaatatgccttatgagctctcgacttctcaacacatttctttgcccaggtagtggatcacaacgtgaatggtcccataattaggggtattgtaggtaaaggtgcttcgacatatgtataaatgatcgaatagcgataaccggccgtgactacagggaccccctttacaaaa

SEQ ID NO: 1973 - DNA, 474 bp, Unknown
  Description of Unknown: Chicken calicivirus ChCV-052, complete genome.1 sequence
gtgggaaccctttcctcaaactccggacacggactactctccgtgtttccctcatcaaagagggcctcagctggcgcaagtcggctggggccccaagaatcacctgggtggatctctatggcgactggggtcgctttgactgtgatcccaccccactctttgctcgtgaagggtgcatcctcactgaacaccctcgggcagagatgcaagggtggaagtcgctcctgccccctggcaacatgcaggtgcccgatcccaagctcagctctgacttcctctcctgggtggtgcaacactccaaggttgatgaacaaacctggagggacctcaaggcaacctggtctctcgaggatctccggcgcatctccacagactacctcatgctcccggaacctgagaagaacactgatgcctatgatggctggctaatggtcggcgagatgttgaccttagccggtctcattggctgggagg

SEQ ID NO: 1974 - DNA, 474 bp, Riboviria sp.
  isolate sto073pic1 genomic sequence.1
tcttgctcgatgtatacaaaattatgatgtaaataaaacgttgagtattgctattgtagaaagccgtgtagatttttatctttatatcctaggaccacggaaagcagccctttattgtccaaggaaacatcattgctgtacattggttaagtagccgtgtgcttaagaaacttacttactgaacaaaattttaatgctaatcctgatgttttatccgttacgacccctgattcaaatgatactataacccttcgcgatgatggcacaagagtttccgaacgctttaccgcttgtgaaggggatttgccttcttccctgtacgattgtatcggtgaaaagagtgaccactctatctccgatttcttgagcagatatgtgattatacaacaagggacgtggtccagcacgtcggtgcgcggagacgttttgtctaatcttgttttccccaagaatttgtttaatactggccaatat

SEQ ID NO: 1975 - DNA, 474 bp, Rhizoctonia solani fusarivirus 3
  isolate BR19 RNA-dependent RNA1
agagcagccgtttggctgcctggtaccacatcataggggatcgccctagtggtgccccagttttctcccttagaccagcctatcttacggctggttgtccttattaaggatgggtttggttttcttccaaatttatagtcgcctggtgcgacttcatcttttgccccctgggccagctgatgagctggggccgaaactgctggcagtcctggcgttggaatttgtattccgactcccccctgtattgagaacacaggtggtaaattgaatctcacggtgccattgagttggtaaccagaaagcttccgtatctcgtctgagaggaaacaccggttgaaacagcttcggcgcgtttgcttgtgcgtacaacttggagggttagttgcgtttttggtgctcagtcccgtcaaatcttattcctttaaactgtttgaacgtagcaaagaccttgcagtcagtagtaacgacactgac

SEQ ID NO: 1976 - DNA, 475 bp, Morchella importuna endornavirus 2
  strain MiEv2SCYDJ1-A1, complete1
gtcgtcaacaccaacacctaccaactcacaccaaccaaccaaactacataccaccattgattacaaatctttgtccgagaacagcccctcggacaaagattaccaaaacaacccccataaattgggggccaagggctgcgactcgctagaagtcgtaaattcatctagcacaataactgaatggattcattccaagcggaacgacaaatccattcaaagatacaaatcacgcggatttacgacatgggatgctgttcacagtacgccgttcggaatatccgttgagaaagaaactgagttagctgagaaatttctcaatgaattagcaacacgcagctcagaattgaaacaatgttacaacgaacaagtggtgtgggaagaagatgaaaaacctgaaccagaaggtccggaatttgaagacctgcagccgctgaccgttggagccgccacacactgctggttgaacataccattc

SEQ ID NO: 1977 - DNA, 475 bp, RNA virus hoopoe/BBanka01/2015/HUN
  complete genome.1
aagataataaacgattaattataaataatagtacgaataaacgtaaaatgagtcatttaatatatagcgatttcattaaactaagagatgaacttcaacaatacttcacggaggcaatttcgttaccggccattcattacttcaaaccaaatcaaccagtcaccttatcagttaacatcataccatctggggaagttaatgacgaccttattagcgaactcagggccaagattcaacaacgtatcgccaagaaatccggtattaaaccgacgcttggggagacgtacccgttatatttatccatcaacagggagacgattttaaaaattcaagtgcatatgaaatatgcttataaggattttgaagcgattattgacgagatagattttgaactagtagaggcaattaaaacattgaaagacaccaaaattgatactttaactaagaaaagcgttatcgataaacttttaagaaa

SEQ ID NO: 1978 - DNA, 476 bp, Plasmopara viticola lesion associated dicistro-like virus 1
  isolate3
acatcgtgtaataaggcactagatgccccaaagcacaaaattgggtaacccgaactgaagcttgtctcaacaccaatcaatcgcagaaattggcagtggacggcccatggcgcccgaggttggactcttattgttccggctatgttataacctctgttcgcaagttatagcgtagtgctatccttggagaaatcctaaccagtgcctttggaaagcacaccaaaacaaaccttgacctggacatgtcattaaactgtccaaaacccaaagtcccttcaggacaacaatccatcgccagaatgacgaaaactcacggtcgagttcgaaccacgagtcgagtactcaaacttagatggatttctttgcgtaacgagcttcgaaactcgcgtgtaaagttgctacgatagtgcgaccctcttaggagaaggcagagcttaaccctaagttgtatcttgctcgcgttacgacaccaatct

SEQ ID NO: 1979 - DNA, 477 bp, Rice Tombus-like virus 2
  isolate FYBPH-10, complete genome.1
attttccctaccaggacataggaaggtgttactgagtcctggccggcctgtgatggccaacggctgaaaggccgtgcctgtagtcgagtagggaggtttgcggtagcagcatcctggacaaagttaggtgtacacccaccttgccaatggatgtcaggacaacgcattgctccccccggcccgtctgcgcagaaccatggtcaatggcgcttatggcctgcaatggtaaccaggttgaattccctggctgtgcttaggagtgtgacgggtgtccgcgtcgtgatttatagggcgggcttaattgggataccgagggtaggcgccatagtctgggtaaccaggctcggttctgctaacggctgcaggtgtgcgcggcgagccaggggacactcctaggccccctcgccagctctgcccgagcttaagggcattataccttgtctggggtttaacagggggtggtggccttcaccattc

SEQ ID NO: 1980 - DNA, 477 bp, Wenzhou tombus-like virus 9
  strain WZSLuoI85212 hypothetical1
atttcacccaggattcgcacatcctaaccatactcgtcgcattgttcgcgcacaacacctagggggaggtttagaccccacgcactcactctgttggagagtataatccagcaccacacactacatgtgccatataggaagacgtttgcgctgtacgcagtgttgcgcaactgagctagtgctcccacctccatgattacgggcgattgattgaatgcgcccttacaattagttagaacgcttggaggtgagagtgggaggggtatttaccccagggagcagagccgagtgcccgcttaagacggtgagagccgttcagaaagtttggctctgtgggcgatcgcgtatgcaggattaaggtatccgcatatgttaaactagcacctttcaaataataataataataaacaaaacaaaaatagagcaccattcacaaacaacaaacgcaatgtgcggcgccaacgggcgcccgttgcg

SEQ ID NO: 1981 - DNA, 478 bp, Nora virus
  isolate Umea 2007, complete genome.1
gcaaaaaggcccctgggggggggttaatgagtactggaaaaagaagcgcgagataccacttcgctgattatgctgattctggtattaaggattagtagagtatcggaagtgccgaagggaataatgctggtccgttgtaaacaggatacttatgaaacctcttaacagaaactttgagcaaacaacaaataaacgaacaaaaagagttatatattgaacttgaaaaatcaatatcttttatttagattgatttatattagtctttataatcgtagggaataattctcatctaatgatatcgatgtaaaatgtatcattctagctattcaattatattaattgagcttagcatctgattaaattactattgtaaaataatatttaatccccatctttgcaagatggaaactcttaataagtcaggagtataatggatttaaaccctcacaccgaatcatgagtataaacagattcaaat

SEQ ID NO: 1982 - DNA, 478 bp, Orycavirus sp.
  strain GUNCC_DN53589-3 polyprotein gene, complete1
ggggttaagaccccagcatattttcaccccacagcccttggggttagcctacaccttcatcaagatgatggtttaggtttgggcatggaatttgacttcgaccttgcatgtctgaccacgaatgtcatttcttcgttctggctgtagacgagactcggtattttgtattaaggactggcagggcccaagtattggcctaggagctctacatggctaccaggatattcaggccgataggatgtcccagcatctgtgtaggactgtttattacgccaatgtacctctgactctaagcactagagggagggggctgctacaggaaaaggacggcattgcctatccgattcacgtcatgagatttctctgacctctggcctgtagtggctactccgggatgggaaacccggactggcctctcactgcctgatagggtgtcggcggacacagtgcttagttttatagtccgttgtaatgggac

SEQ ID NO: 1983 - DNA, 479 bp, Beihai picorna-like virus 6
  strain BHNXC41284 hypothetical protein1
gcaaggtttatagccttgcagtctctgtttgaatagttgatagttatatgtctatgtgtttagtgttgtacgttcaattatttgaacgtgccgctctcgatacatatgtcattataggtattgattgttcaatttaaactcgtttttcgtacttttgtcgtaaaaaagttcactttttcagtctactatcaagactttaaaaggatagttggagttttcgcacgtctccgtaatttacacttcgtgtagtgcaatctccggtactttggtaatcagccggattataaatttttggatttactgagctaacagtctcctcatactgtacgtcgtgcccatagatggtacgcaaattgtaggtattcctactcatggggtttaatggtagtactgatctggtaccccggctattatagcctaaacaactcagtttttgccaggacgctgttatttataacagtagtcctggcgtatatatt

SEQ ID NO: 1984 - DNA, 480 bp, Partitiviridae sp.
  isolate H1_Bulk_29_scaffold_1403 hypothetical1
ttgctcgcattggtgctcgcaccaagttaatggttgattggatgatcggttcttgggaaaactacttacgaccgaagacgtggatggacgcactcgaacaagaacagcaggagaagtgggcagctgcgaagcgcaggtacgaccgaatgattgaccatgagaatcagaggttggcaaaggcgcgggctgaatacgatgccattgttaacgatgtttctctgaagcaggccacggctcgagaagaacttcgagacgttctgagaggatttgggttgcaagatgcaccattactttcagtcccgtctgaagatcatggccatgaaaggctcagagaggaactcagctttctggggataaattttcgtcccccagatagccagttccactaatcgtgttcaaggaacaatacgcactctcgctagacgagcacgccggttaagaatgaaagaagcagcgacacagagacatcctatagagaaa

SEQ ID NO: 1985 - DNA, 480 bp, Unknown
  Description of Unknown: Mutant Zaire ebolavirusisolate Ebola8 sequence
ctaaggtagaatacttcatattgagctaactcatatatgctgactcaatagttatcttgacatctctgctttcataatcagatatataagcacaataaataaatactcatatttcttgataatttgtttaaccacagataaatcctcactgtaagccagcttccaagttgacacccttacaaaaaccaggactcagaatccctcaaacaagagattccaagacaacatcatagaattgctttattatatgaataagcattttatcaccagaaatcctatatactaaatggttaattgtaactgaacccgcaggtcacatgtgttaggtttcacagattctatatattactaactctatactcgtaattaacattagataagtagattaagaaaaaagcctgaggaagattaagaaaaactgcttattgggtctttccgtgttttagatgaagcagttgaaattcttcctcttgatattaa

SEQ ID NO: 1986 - DNA, 481 bp, Magnaporthe oryzae botourmiavirus 5
  complete genome.1
gggggtacacaggttttggcctggttcccggggattgtgctccacctgcgctttctccgagatttagtgctccttcggctggagagtggcaccgtaacgcgcagtggcgacgggccgtggttgctgggcatcacccagtgtaaaagggatgtaggggcattgcccgtaatccggtgaggaaggtaccggtcccaaaggggggaggtaaaacgctaatcaggcgtgttctgcgactgtgcctcgcgcgcggcagttcagacccggggactaactgtcccgggcgcaaaccccggcgggttgggtggacatggttgtcacctttcccttagatctttgcagtcgtaaaagaccgggccaagggggccctgaagtctataaaggtgggcgtcaatgcccaagcttcttgtcaacacacaagcgcgaattgaaacccctccctgggtcggagtaaaaggacccgcctttaaaagtgaatgataaa

SEQ ID NO: 1987 - DNA, 481 bp, Wenzhou picorna-like virus 10
  strain WZSLuoI86114 hypothetical2
ggggacaacccagtctttactgatcacggtagacgttaaataaagagatcccggtgttgtccaatgctggaggtgttaagccaaaatcaaaatggactgctaagtaagatatacgcacagcgattaggttctgcattacctattcaatgtggtcaggctgcttagtggacttgtacatacccctttttaggggagggtttggtcacccaacaaaatagcactgttatgttgtcgattgatgtgccgcacataatatttattaaattacattactaatctttatactatttgtgagccagaatcagctcaaaatgattcacacatatcgtgcgatcctcgcacaattcatactgtcgcgtctttcgatgaagatgatgaagtcttgcaacttcgtgctcgggtcagggagctacgacaaaaacttgaccgaaagtaccgccatgttaagcagctcactaaacgaattgagcagctagaaggt

SEQ ID NO: 1988 - DNA, 482 bp, Marr virus
  isolate Antarctic64 RNA-dependent RNA polymerase and1R
tttattaatactttcagaggaaactcttatgacacagaagaatctggtccttatcgagtctaatggctcgacccaactttatgggcaccctgaaaccctcgcgaagaccgtaaaggttaagcgctcattgtctactaaggcaacgagtacgggcgtaaaggtaacgaataaccgtgttgaagtcgttatcaacgcggatgtccctgtcaccgtctgtggcgactcgtgcgccggcggctccgaggttctgtctgtacgtttgtcaacaagtggtacaccgaaaaatagtgcagagcttgatgcaatgcttgatacgttaaaaagtatcattgacaaagctaaggcttcgcgcttaacttccggctacccaatgacccaagacttagtctgggttgatgtagacgaagcgtaacagacaaccgttaataggagagcaaccagtgaaaacatggaagctagaacgccgagcacgtgatgtgcta

SEQ ID NO: 1989 - DNA, 483 bp, Sclerotinia sclerotiorum deltaflexivirus 1
  isolate AX19 polyprotein1
ttttgtatttatggtgtttgttggttgctttgctttgtttttaactcacattcttttgcactttatctctctaatcttgtttctgctccgccacactctcggcttaaattgagtggtctcgctgtaccataccagcgatatttatctatctgaaacgacttcaggtcgcaaacttgtcatcacagctaatgccatccgaggctggtccacctgtaatgggtgcatatggtgtacttggtcgtgtaagctacgataacccaagtgctgatcgtcccgatcgaggaacgggtgcaaaataggtgttcacttcatctccaccccaatctcgaggtaaccagatcttctcccaaactggtgcgttacgcatgattgccgaatcctctgcgtacgtgtctgggtttgacccccaggctctgtacagactgtacgggcgaagggcactacattccctagtgtcttaaagaaacagtcggcccccgagta

SEQ ID NO: 1990 - DNA, 483 bp, Heterosigma akashiwo RNA virus SOG263
  complete genome.1
tgatagaaagttctgcagtattctgcagaactttttaataccctttgtagagggatatctactttaattgctggtgtgcgccagctcgcttttcgatgtgattcataattaactatacacttgagcttaaaaccaattgttatgcgtaggtagcgttctttagcgtctactgtagtgtaattaatttgtttgctctagtggtgtctttgccttcaaagtactacagagtaagttcatttgcatagttgtgttgtgatcatgttgactagcttgtttgcgtgctccattaataacatcagtcccagctggcggggcaataagtaccagcctggttgttgcaagccgtgccgaaagaagcggtatcacgacccgtgtccctccatgtagtcgttaaaaacaagtgaggtaaggagttgtccatcttcgagaaaaattaataaaatggacttttgggtctttggcccccccccgcgttaggcacct

SEQ ID NO: 1991 - DNA, 483 bp, Beihai barnacle viurs 1
  strain BHGZ polyprotein gene, complete cds.1
ttgttgatgctgtagcccagtggtctccgcgggtgtggttaattgcggcataaagactttcttgcagcaggttttgttgttggttgttgagtatggcgcgtgctaggggagttggttgagagttgttctttgcttgtgttccttagtgtgtgccttgtgttgtgtacacggtcaggcgagtagcctttgctgtgtgtacagcttgtttgtgcctttcgcccaacgtggtggcgggaggtatttgtgtttaatcgtcgttgagcagtaggctctcacggcgaaacgtagcatattgtgtgttatatttgtcgtgttcggcgaggaggttttctcggcttgagcacgatatactgtgttgattaaatttaagtgtagttccttgcgctctgttgggtaagctatccctacagagcgcgagatcatattgattgaagcaaaacgtgtatagtgtatattgtaacttgttagttgtaaaaggacaaa

SEQ ID NO: 1992 - DNA, 483 bp, Yado-kari virus 2
  isolate E97-14 replicase gene, complete cds.1
tgggggtagccatccctagtgtaatttcttacggggatgcatccttgccctttcaggaaagtaggatgtatctttcaaaggaaagataagctaaatgtgcatggcacaaggttagatggaaggaaatgtccatcggcataagctcagattgatttactgtcaaatagagaaatgattcgcgtcgcttggggcccagtttacactgggcgcatcggccccatatatcatggggtgcgctacgccgtagcaagcattgagaagtccccttaagcaagggagcctttgccttatcgactgtagataaggacggtgatcaatataccgagtcacgacaaagaaagtgacacgtcaacgcttaaaagtcgcgatggatatcaccactatactagtggtgtgaaccgaaatcgcgcaaatcgacaattcatatttcgataggattaattgtccaatcggcgttccgattcacgtgagaatccgttaatc

SEQ ID NO: 1993 - DNA, 484 bp, Wenling picorna-like virus 8
  strain WLJQ103995 hypothetical protein1
cctagccgggctttacccggtttggtcgtcttttgcttatgtggtatattctccattttcgaatggacgatatatcgcataggttttctattctcttaaaaactaactatatctgttatatatttgtattgtttataaggtggtgggtttagagttttaattgtaagtaggatactctacttccccacttttgttttgtactatgtttaaggtagcacctaatgtgctattcttagtccaccgaagttttagtgaaagcaactgctttagattattttgccctgggtcttacccacttgcatttacgccgtgaggtattgtgcttgatgttggacagggatctaaataagtgacctattttgttcttggtctttgctaacgttgttagtagctattaattaggtggtactgcgcgtaagctagaacttacgacaagtgacctgggtatgtcatttaaactactcattcaaaatttacaatacat

SEQ ID NO: 1994 - DNA, 485 bp, Hubei mosquito virus 1
  strain mosHB236488 hypothetical protein1
tacaaaaatccttaaaagtcagagaacttttaaaacccccggttagcacaaactagccacaaatagtctgagtactaccaaacgcacgtattgtccgagcacaattacgtaaaccaacgctacaatcgcacgtattgtctgagtacaattacgcaaaccaacgctacgaacaataaagcccataattttggatttatttccacaatttacgctatttagacttatcgctgccctccactatagtggttgtatcatctctctcggacaactgaatacttccaaggtatagcgtcgcagtcagagcacagcgcctaaatcttggtataaacgaacgtacgcctacagaagcaacctatgagttacacttatactgctctcagctcgagcattaccgaacgagaaaacatcaacgatatcgacgacacaactgttgacccttcagcctcgttcctagtgcccgtcagcgaacaagtgtataggccaac

SEQ ID NO: 1995 - DNA, 485 bp, Hubei noda-like virus 4
  strain WHBL72570 hypothetical protein 1 and2
gcgctgcgcctgattagtccggaatgacgtaaaactaccaaactaccccttgcttgaggctaacaaagcgcgtgtcccaagggacctaaccgggggtgcgtcctataggacgataaacaggacgcccagattccagggctatccggttttcggcggtgcacccagcatcgccggcgacagtgcgtctagcgctgtcgtctggtccgcaatgacgttaaactaccacgccggcgcaccacgcgccgtcttcctgtccgcaacgacgttaaactatttagggggggttggtacggcgagctgggtcccgtccccgccaccgcccccctgcagccctcggggcgttgcagcagcatgaccgcggtcagctgccacgctcccgggggcgattgagtcagcctccaccgccccgcggggcggggtgttaagctggttcggtgtttctgcggccttactgctcgatctccaacactattcggtccgtgagg

SEQ ID NO: 1996 - DNA, 486 bp, Galbut virus
  strain MELplus21664 segment 2 orf1 gene, complete cds.1
cttattcattctgcatcatggcgtttataaataataatggtaatgctaaccagcgtggaatacccgcacaacagcaacaaagacctcaacagaggcgtccccgtcagagggattacgatcggatgttgtcctacaatcaagacagagctggtccgtcttgggcacaacaatcccaaccggtttttgagtatgagcgtgcaatggaacgcctcaaccggcaacagcaaccccgtccagtacagaagagcacgggcagtagacagcagaagaagcctgccgacagaggcccagagccgaaaccgacaacagtcgagcaggggcagcgagatgatccgatgtacgaaggtccatgtacatcaacaaccgccagtaccacattgtttggccacaatctggactacagcggatacattgccctagtccgtgagttctacatcaataccacggcactaaatccgcgtcttacacgcggagttacccttctgc

SEQ ID NO: 1997 - DNA, 486 bp, Picobirnavirus sp.
  hypothetical protein and capsid protein genes,1
aataatataggaggaagtgcgaatgaaaaagacatgcatttctaaggtgaaacgatttctcatctatctattggcgtacttgttgagcacgctttgtagagaagcaatgtgtattcacattgtgaagaatcgtcagtgttattccgtgactgtaactaacggaaaattaaataaggaggtcaagtgatatgaccaaagtacagagcgctggagagcgcaagagctatgtgatgactatcggagagtatattggtaaggctcaagggtggctcaacacgctgcagatgatgcacgcatacaacatgaatattgatgcgaaatcatcgaatatcaaaaccggtactgaacaaggtcgaccttatgttgtggctacttatagttacactatgattaagggtcctacttctgttaaccgggtggtaacttggatctgggatgatgatcatcctgatggtgagttagcttactcatgcggaggtgattaat

SEQ ID NO: 1998 - DNA, 486 bp, Acinopterus angulatus reovirus
  strain Fresno1 RNA-directed RNA1
agtttttgcttccgaagtcatatcacacttaggcggggttaggtctgaaggaagatatagcgaataaaatatatagtgtaaattaatttaatagaatattagcattcaaatttcaatggagcagacggagtggtggaacagttactaaatgatagtagaggaacggcatggtcacagtagagtttagtgaggaggataccagtaatataaacaaacaagtctgagtaatatagttaaccagccgaaattaagacgacgtgaggagattctactgagacaagagctggagggtggaccacgtttgaagaatcatagaaagatgatttggagattaggtcgaaattgatataagtgaattaaacaatacgcttagagagccaaagatattagtagtaccatgttaccatataataagactagctactaaagagggcgggtttagtgtgatcgattctttcctaaagctatcatgtctaaattttctga

SEQ ID NO: 1999 - DNA, 487 bp, Myrmica scabrinodis virus 1
  isolate Cambridge-Msc, complete genome.1
acgctgctaaatctttagctagtggtgcaggcaccgctgctaatgtagttaaaggcgttgaagcaacagcttcagcaaccccttggggtgcaattgctttagtcaactcaatgttgggtgatgcaactgctgctggaattgatgctggaaatcgttctacaattaacaaagacttccaagcaaactcgatgcaacctggatcagcttcacaatatcaagctggattaataaaggacacacaacaaattcatgcgaataatgagttagctggcgcacgaattggaggtgtttttggaccattaggagcttattttggctcacttttggctaatgcacttcaagataatgcacccagagatctctatgattcactcaagactggctattcattcgatggaaaattcaatccccaagatacaggatcagttaattcaggtacaacagcaaatttatctggagaaactaatatgcaagataatttaataac

SEQ ID NO: 2000 - DNA, 488 bp, Nanhai ghost shark hepacivirus 2
  strain NHYJG60710 polyprotein1
gaaaggaaacgtatgacaagtttgggctggaggtcccttacccgtaccaatccccgcatgctctggattttgaggcttcgagcctgccacagagcctctgcccgtgggtggcgccgccatttatgtcttctaaatctcacggcctttctttctgttaagtgtgtctggctaagaaccatttcgacccccggggcggcaagcttttcgccctgaccctgggccactcgggacacacgttctctgctgcgcgatggccgtcgcatgcgtgcgaaccatcagaattgcaagtgtgtgggaacggtttgactgtaaccagtactcttgggacaaccagcggtaacgctggcccttgggcaggcttcggcagctggtgtgaaccaatcctaggtacctgccttgcatgatcgtaaatagctgtatgtaagatcgcgccgcaggcaggagttggcggactccttaaacaccgtcaaccccaaaaaactatatat

SEQ ID NO: 2001 - DNA, 488 bp, Iflaviridae sp.
  isolate muf159ifl2 genomic sequence.1
agctggattttaacgatgagaagcttttaaattgttcatggtgatacccccctccccagtgtgattgtccatatttgtttgattgatttacgatgacgaaaattgagtaccctgtaatgattaattctttgttttatgaatataatatgacctcttatgctgactagtgtgagtgccgctagttggtggagtatgatgttatacaattgtatattaaatttagctctgagtaaaatggttgaaccccatgttgaaatgacgctatctgatatacgaatgtatgagccagaatgttgacaacacctaataatgcacaattgcaacaacttcggttggagcctcaaactgcgattggtcatgtaatttactagctttcaaactatcgacctagacaagtcttagggagtttgaaagaataggaaaccaattcgtgaatgtttgtgtacccgtgtcggagcggattattaggacggcggacgctttaaaag

SEQ ID NO: 2002 - DNA, 488 bp, Beihai hermit crab virus 1
  strain BHJJX25619 hypothetical protein 12
gcagcgaaatacaaattcctgtcgcaaaagagtgttatgaggagtcacgaggtcaaaactcccgttttgtaagtttagtgaacactttgagttcattagcggtggatgccgcgaaacattttgtacattttatattcactccaccgagtttgtatttgtatagaaaattgtatcctagttctcaggagctgaatgcagatgtacaaggtgggggcgatcaaattgccccacagattgattcaaatccggccctcacgtttgtcgatcagaacgcaggtgcagaagatggggtcgacacttatgttgaccctctgcgttccaatgctgaggagactgcccccttctcggaatggaggaagagacctgttctcttggcaacggtcccttggcagactgggacagatttggacaccgttttcaacccatgggtggaatatttttccaaccagtacatcaaagaacgctttggaaggtttcatatagcctcc

SEQ ID NO: 2003 - DNA, 488 bp, Beihai picorna-like virus 90
  strain BHWZXX14572 hypothetical2
ctgccccgtccaggcataaaacggacaccacctccctgtgtgatcttactcagtggccaataacttggtcctggaacatcactgagcatgctacagggggtagacacctaagggatggtgcggagcagccctccggaatcccatcaggacctagcagtgacgaccttgagttgagtcgtgaacaattccaatgtgaattgtgctgcgaaatacccagacttagcattcaagaaccagaattatatacaggacagactaatacgacaaccgcttcgctacctgaaatagcgacagcggcgacacaacagttgtctaccaccttggtagagaacgcaccaccacacaatgaacaacgccagattgaaccccgcgcatatacaagtacgaatgcctttaaggtagatcggccagaattactggaaacattgtccagggaggtgacagttgtcaccggcacctgggatagtagccacgtacaaatagccgac

SEQ ID NO: 2004 - DNA, 489 bp, Picornavirales sp.
  isolate zftwig05rna2nc genomic sequence.1
aaataaaatgtttaaatacaaattgtttttcgattcgattcgatttgttttgggttttggtttttgggtcaagaccgtaaaacggttcaagagaattcgtaaaacagatcgccgctagtcaaagctagttcgtacactagatcactgtcaataaattcacttttagtcgtcaatggtcaggatacttccgctttaagggcgcgtttgtatgattgcctttatatttcttttgataacacgacgtgctcatcccaccttgttagtatcccactaacctggacaaatctcgtgttttgaaaaatatattaatttatttgcgtaaattactatatttagtacttcttatacttaaattccttggagttaaattgcttattataacaatagcattttgctttttacttggatttattagtaaaagaacttacttaaccctaaccctagtttttggtgtgtacaatttatttgaaacataccaagaattcaaaa

SEQ ID NO: 2005 - DNA, 489 bp, Hubei picorna-like virus 24
  strain WGML142000 hypothetical protein1
cgtatggagaacatacgcaattattgccgtctaacgggggtgacgtaacaagaccccggatgagtccaccacgtgtggcattttcagccgaatagattcattttatgacgacagattaatggaaatgttttagtgtttaagtaaaagggtttggaaccttagagtaacctcgatagtatatttatatactcccagaacctagccatggggatgggccgttgaggcaatgttctaagaccagagattttaaagcttgacaagcgctttacctgagattcctcttttgagtttgaatatattaaagatagtctaaaaacatttatcagttaattatgttagagtagctgaagacatgtatttcgtgctctaacctctgaaatgttaaatgtttgtccaatggttcggtgatcattggaatattagcgaagttaaccttcatctttaataatcctgtgtcggagcagtggtaaagtaatcggactattaagc

SEQ ID NO: 2006 - DNA, 489 bp, Hubei tombus-like virus 1
  strain WHWN54407 hypothetical protein 1,2
gtagttgggggtggctctgatggtgtgtcaggtaccacccccgccccatccggaggtggctccgacggtgctgtgggtagcaatcccacccctacgccgaccaggacgcgttaccacgcggcctcggctacaggtgtacccgcaccctacgacttcttaggattaggcgcggtttaccaggtcacttccgatttggtataccagaggtttgacgatgtatggaagctcgccaattacactgacaagaccgtttacttccagctcaaggttgtgtaccacaatcttgcgttcgatacgtccgttaggtatggaaaccaggattcctattcttaccataccgacgtggcgtttgacaacaatggcggtaggctcgtcactgttacaggaaagctgcaacctgctgaggcctggcgttcgagcatctacattaagtggaagttcggagtcacccccccagacatttactggaccctgaagacagacatatac

SEQ ID NO: 2007 - DNA, 490 bp, Beihai picorna-like virus 123
  strain BHCL81476 hypothetical protein1
tattttaaacactaatttaagtaccttgttttattttataaaacttgcgacttaaaaatgtgtcttctttccttatcgtttttctttatgtttgtattgttagtataaaagtgagtaagtgattcatttcatgcttttcttttattcttttaaacgatattatacattcaataataagtgagtaagtactgccagtgcgctggaatgtggtagccccacttttggaaagctctaaatcttatgttgattgtattatatttgttttcggggttaataatgttccctttctaatattattattagtctgtaacactaacgtacaatgacgtgatattcgtcccagagggaaactggttaaaagcgtgcgcgctacggcgtgggttgatatgcaaccaaagacatatcgttcagccctcagcgaacatagtctgagggaagcttgtcagtgctttaaactgacaaattttattttactgctagagaaatcgac

SEQ ID NO: 2008 - DNA, 490 bp, Mayfield virus 1
  putative non-structral polyprotein gene, complete1
gtacaggcgcattcgagagaagtgttattcgcagttgtatgttccgagtacctgaatcacagattcacagaaaggtcattaactgtcataatagtgcgtaatcgaaatttactgtcaaggggaacgagagtgtaaaggtttacaacggttcgcccgaagtacttggtttttgtgcgctttacagtgagagaagcagtatttacgacgagtaacggagtaacaggagtgagaattcatcgaaaggtgcacttcacgattaaatacagtgtaattgttgtgtcacagcaacgagacgagcagtatttgtgaatttgtgtcgagtaattggatcagggacccattgaaacggcttgttgtgttaaaatacagtgtaattgctgttattacctattacaatataattaattaggataagcgaaatcgtgcattagcacatcgattatagaattaggttaattttgttagcgattgttagcgttatacccgcaaa

SEQ ID NO: 2009 - DNA, 490 bp, Sanxia atyid shrimp virus 3
  strain SXXX37589 hypothetical protein 11
cgtagaggtgttgcctctgcgtttatttttgccaccctggctgggtgcttgtcaggccgctatagacatttcatgtttgatgcatgtgtggacgtggtatctgcctaaggaaaagtcttttcattgacggttttattacttgacttactattttagagttttttgactgtgtggggagtgttattttttcgttggcagtatttcgttaaactggccgttattcttttaggtgttggagacgctcttagttaatatgctgctttctttttagttatcattgatctggattgatctgagattatattgaaagcactatgttgtctgtgaaatttgcgttagccaacactagggggatatcaagtccctagcttcttgtgagtatgtggatatctcgcagaaccagttgaaagcactggatgaaatccgcaattgctatgcaattttcatatccgctcgccgacggcggtatataaatgtcggtcatggaaac

SEQ ID NO: 2010 - DNA, 490 bp, Beihai tombus-like virus 11
  strain BHHK128439 hypothetical protein1
atcagtccattcgtcaagctgatgacttgatccatcaacaatggtggagcactaatgtcaagcaacagcccgagggattatatgtaaatgatggctggtatgttgagaaatgcaccatgcccacgacatattatccgactgatatatatcatcctcactactacctgtataacagattaatagatctgcaggagtttgtgttcggtaaaaccgaaataaaatacatccccgagctttattcacaattgaagttaagatcgttaaacctgccaagagatgatttgcatcataatcaattaaggtccgcggcagttcagattcttaaccagaagaacatcaatcccacaagggttcatgatgctctgatgggttcaattaccagagccatgatacctgatgatgatgagttatcaagtatcagaattcgcaaatccggtcctgttaaggccaggcagagcgaactttcgggggaaggagatccaagcacccg

SEQ ID NO: 2011 - DNA, 491 bp, Alternaria alternata hypovirus 1
  strain YL-3C polyprotein gene,1
gcctgtgggttcccgactcaggccgccctttcgggcgtaatcggggtgtagttactgcgctttcagcagtcaactttgtcaagatgatgtatctttgactgttggcgttctttaaactacggttgtgtctaacgacacgttctcttaattgagagtcacgctatgcgtgagcccaccaagtggggttgctgggtttccagcggttgtcgctcgcgacagtttcatagggttcacgtcgcccttgctaaacgacgaatttggttttgcttcctggttatactgtgccagccttggtggcacttaaacacttgaatgcgcacaccttgaatcgtttcgccgtcttcgccggtgtcaggatttagggccactgttctatcaagagggataagccgcgcctgtctgtgggtagttggggatgaatagacgtccgtggtgcaacgtgcacggctcccatttcaacaactacttggacgaatcagagcgtaaggtaa

SEQ ID NO: 2012 - DNA, 491 bp, Hubei tombus-like virus 34
  strain WHBL73047 hypothetical protein 1,1
gtttcggtacgccgaccgtgctcgctcagtgcgagcacaacgcgctaaacgcgctgtacaaacgccatctttctgccccacctaacctttgcacccgccccttccactcgtgtttcctcgactacattcaaactaaacttgttcctcagtttcattttgtccggcaatcctgtgaaggcgcatggaagaagaagaagacccaatctaagcttgactcgatcgaccggtccgttgtttatgaccggttcgaattccaaagagcgaagtcctttgtcaagcgcgagattagtgtcaaggttccgaagaaagcccgtttgatacagggcaatttcaatgaaacgacggcctaccacgatcctgatactttcaaggccatctcccatctttttgaagacgtgcgcttcgaagctgaaggcgtttcgttcgtattacggtacacatctgggtgtactaacgccgacatcagccgactgttctccgacgaggttgcg

SEQ ID NO: 2013 - DNA, 492 bp, Marburg marburgvirus
  isolate Marburg5
ttattgttcgaagattgacaatttgatcactttcagttttcaatttcaacccttatcgcgagatttggacacgatcttactaacttcaataactgaccccaaattcaagtttactaaaggctaagatgaaaataatcactagtttgttgtaaattactcgatcaaaatgttcttaagctatcttcaacttaatgatgcaactctgtttcatctttcttttgatttcaatgtcacagctatatccaagtgtctaattaacaacttgtacctctaaggaaaaccatgaagaacattaagaaaaaggatgttctgattcttcaactgaacttgtatatcctttattgatacccttgagagacaactgttgacgctagatcacggatcaagcatatttcaatcaaacatcctaaattttcaatcgtacacataataaccattttggtagcattgctttgcagtataggataggtggtcgtgaaaagacttccaagc

SEQ ID NO: 2014 - DNA, 494 bp, Human parainfluenza virus 4b
  strain HPIV4b/Seattle/USA/SC0496/2019,3
tcatacaaatcaatcactgatatagagttaaggaacattttatatccttccccattggatcaccattaccatcctgatatataaaaccacactacactatgcaccgtccaatatctagccgaccataagatcacaaccacattacaccaattcaatcaaggacatccctgcaaacatcaaacaatcaaaccacgactgcaacagacacagcaccacctgatcaagccagaccctcaccatgcacccaagtcacccgacacaaccgcaaactctcgactccactattcaaaacacatcctcgaacagaccacccaaaaacaccgaacaatcaatctcctggccacaacgatcattgtaaattttaagaaaaaatctaacacacaactagagccaaatacagggggggaaaaacgcatccgccgccacacgcacagatccagaactcaaggcaaccaagacccgccagattccgctccatcttcaaagaaatcaac

SEQ ID NO: 2015 - DNA, 494 bp, Human rubulavirus 4
  strain t146a296_HPIV4, complete genome.2
tcatataaatcaactattgataccaggctgagcagcatcccacatccttccccactgtactgctagcatcattcagatccatagaaccacaccacaccatgcaacaactgacattcagccaatcactaaaacacaaccacaacacaccaattcaaccaaggacatcctcataaacacaaaatgatcaaaacatgattgcagtagatacaacatcaccccatcaaatcaaaaccccatcgtatactcaattcacccgacgcaactacaaatctccgaatccgcccccagaaccacatcctcgaacagaccgcctcaaaccaccaaacaatcaatttcgcaattgcaacaatcattgtagattttaagaaaaaaacaagaacacaataaataccaaacgcagggggggaaaaacacatccaccgtcaagcacataactctaaactctgaggtgaccaatacccgtcgaaatccgctccaccaccagagaatccaac

SEQ ID NO: 2016 - DNA, 495 bp, Cryphonectria hypovirus 1
  complete genome
gcctatgggtggtctacataggtgagcatgcgttgctcgatatagaccgccattattggtaacacgcttgaagtgttctcatccggagaaagtgatttgctttcttccatgaggctccctggagggattgtccaataatggttgataattttggttgctgcacaaccggggctttgcccggggatttcatcccgttcaaggtgaggcccttgtagtaacctctccccgctgcgtgagcgaatacataagttcacccagtactgacagtgtcagcgccgcacgtgcgtgaaacgtgtgactcgcagactgaagcgacctatggtgaaaacggatgtaccatctagctgtggagtagtgaccctagaagctaatccgatggttccaccagtcgttgtttgccggcaaacgccacaaacggtttcgtgctttgcgtgaagaagcacggtctcttaagagttcattggtacggttgaccccgaacgaggtccgaacata

SEQ ID NO: 2017 - DNA, 495 bp, Gervais tombus-like virus
  strain GUNCC_DN54311-2 hypothetical1
ggcctattgctagcgtagagttctcctagataacgttttaaatttcttatggcaaaaggaggagttttaaagcagcttaaaccgttggtccaatccctggccgggagttccaggacaatgaaacgaaaccgcagacgtggtggccgtcgcggtggggtgctgaccaccaagggttcgcgtccgcgaacagttaataatccctcgtggggaaggtcgttgccggccgcttacgcttcccacgtgaggccaaggttcaatatttcaagccgtacggcaactacggctgttgtttcagggtgtgatctaatatatcccattccagcaacgctcaatcctgatagtgagaccatattttcaatatttccagctaatcccgcttactggtccggtactcgtatcgcccagttcgcgcccgcttaccaaaattataggccgctggccttcactgttagttacattcctcaagtagcagtgactcaagcggggacagttttc

SEQ ID NO: 2018 - DNA, 495 bp, Picornavirales Q_sR_OV_042
  putative non-structural protein1
cgggcaaatccctgcgcaatcaattgaccccatgctggctgtaaaccttagtgtatccgtggctgtccccacggagaataagtatgtgaaaccatggccgtagattgattgttcaaaccttttgaaccgcgtaatatttaacctttcgagaactctattaaaatctatacatcagatgcaagcgttgattgatgtatactttttgtagaactatcgcattgtaagctctttccctctcttcctttcaagctggtagcccagtaggacgcgatctccttttaagaaacacacgacggattcgaccccgctcgttggcgcacccctttaggctagtagtattggaacttcattctctttgaaggtaggcaccacgactagaactcgtggcagatagtagactcttttcaattaatttctgattaggcatgagcaaagtagctttgaataactcctcatgactggattgtacgcagatttcatccactgcactcagaa

SEQ ID NO: 2019 - DNA, 495 bp, Ribbon seal picornavirus
  isolate RsPV/WVL17251-06/USA/2005,1
cgggagagttggcctcacgctgtttagcgtgagagccggctctcctgccccttcccctgagccggggatcttggctcattcccttcttttctatcctccctcattggactttacggatgacccggcataaacttgacaaccgatgttggatttcccttgtggctgtgatggaggacataccctcgggtgtagttgtgtgcgtgtcgctctgcgacttgagcttcaaagtggtgctgaaatattgcaagcgtcgttgctcaattaacggagtgatacaatcctatgaacccaagtgcattcatgcgaaagccccggaggggtgagtagcatggactcgaatcagaagagctagagctcgcttggtacggcacgtagcattgctttgcctaaagaccaagggggtatggctataggtgggggcctatagcttgtctagtgctggttgacagactcgtgctacgcgtctggttcgagtataagtagctgcaactcact

SEQ ID NO: 2020 - DNA, 496 bp, Xincheng Mosquito Virus
  strain XC1-6 ORF1 (ORF1), ORF2 (ORF2),2
ggtaagcgacatccgagtttataaaaaccctctggttatattacaaaacaaattcattggcatctaattagtaaccgaaactatgagcaacactgtgaatagaattgtatgttggaggtgcagaacactcatcagtgtaaaagcagctgaagatgaaccattccagccttacattcgttgtaatttctgcaacagcaagaactggattgttccttctgggaattaagagtttataagtagtgttgttttcttttcttttgctagctaaatcagtatgtatttctttacatatgtatatattttctattataccttattaaatgtttctgattgagagtatcaatatttaaattctacatcgatagtgagaaacttaatttagaaaaaacctcgtggtcaaagttacacgcaacctagaaaatataactaagaaagaaagagagaggaaaccaggtacgacacctactcaattggcagaacatcattccacttcgag

SEQ ID NO: 2021 - DNA, 496 bp, Picornavirales sp.
  isolate H2_Bulk_34_6 hypothetical protein1R
agagacaatcggatgagttcttctcctttaagtaagaataggtagggtcttaacccctaggttgcggacaccttaagttccgctgctaggtttcagtgtgatcttgttagtgtatataaaatctatagttctaaaacacttaagcagtgctgctgaaacaacgaggtgggctatttagccttacttccaggaagcctggggagcagccctcccaaattccaggaaactatagtacggatttcgttagcttgagtaggctcgatttcttaaaaatttacttgctacaattaataacaattcgggtggctccgattcaaaagctaacttagctccaaacactgttgtggatggagcaggagaaaggacgatagacggtactaccgctttcgtcaacgattcggaagtagtgcaagcgtctattatagcgcctctctccgtttcaagattgctaactcaatcgagtgcagtcgaaaatatagaggatataaaaagatgg

SEQ ID NO: 2022 - DNA, 496 bp, Shahe picorna-like virus 8
  strain SHWC12398 hypothetical protein 11
atcgtatatgcgtttatacgcatatatgattagtagacgatgtctctatcgataaagaacttcaagtttagtatcccacgtgagatccttggagcgacaccccttttacaaataataccttttaaacgtattttcaggaccttgcatgacaatgattatcccccgcactgaatacaaccatacgtggattgtataagatgggaaccttgacaaacatttggtacgcgccgaaaggccatcggagacataatctccgcacctgtatgtagaccactacctggctctcaacagcttgagactttgtcttaaatcttcggattggaaacggctctatttgggtgtgctgataacccctcatcggagacgctgaggagggagattatgcctttagtgtacgccaccttgtcttgcgtaatgccttggttggtattgattctgggggccagcccagacggagctaagttgcactagagttatactggctgttcatatcgcc

SEQ ID NO: 2023 - DNA, 498 bp, Hubei picorna-like virus 49
  strain WGML112833 hypothetical protein1
tgtagtttgacaagctacatattatcttctttttcgtcttagtgtgtgctgcactgccatttgtgacagtgtagttatcacgtggacgttttcttctatgaattgtcttctttttctttcttcttttctcttctttttctttcttttctacattttcttttgaaaatgttctctttttctttctttcttttctctttcttttcttcttttcttcatgacctttgtgtctgaagtttcttcgtaatgtttagtacctttttaaaggaagtactttactcatgttgatctccctatgacgttcaaactcgcgagagttgtcttgggctgtacgcattttccttcgggagggttttgtatgtactttttaagtgggaataaccgcttatgtggttacttctttctatgaagtagagctttcgttgtttttctctttaaataacgcagtttttgaaagtttttctgtgataaaattttcatttctttttccttttcttcatt

SEQ ID NO: 2024 - DNA, 499 bp, Periconia macrospinosa ambiguivirus 1
  strain PmAv1DSE2036, complete1
cttgcaggggttgataccctatggatggacttgatggttcctggtcggtgctgccgtcccaagtccctcgggaactacgccgtaaaagtgttagtcgggccccttgccttgttataacttggggacatagcttggtgctgattgctatgccttaaattgcaccgctttctctagcacaacctgcctggcagtcaactggcaggttgtgctctcctaggcgtttgccacgctggaggttaatgcgtgacctgtgctcaaccggtgccccgccggtcttccgcttaggctaagagcaggtctcgccgcggctgctaaccgcgggttgtgttacaaccagggggggtaaactccagccctaagtgggtccggttctccggtgaatcgctggtggtggtgtcttagcacctcattgccatccgcagcccagtttgtgggtcttcccttggtgaatgggaaaccctcctccccaaattttggttttgtttactggtgatcaacg

SEQ ID NO: 2025 - DNA, 500 bp, Narnavirus sp.
  isolate H4_Bulk_Litter_23_scaffold_4 hypothetical1R
aaaatcatgaacttaaaatgcagctcaacgataccaacattcagcttcgaaagcttcaaactcaattcattgaattccaaacctcacttaaagaacagcacaaagcaatgatggcaagtatcaagcaacactctgatgcgatgaaacgtctcaaagattatgaagatctccatgaagttgatatcgaatcacttccttccgcaacttcatctcaactccgtacccgccaacgagttgaccaattcatcaataccctcccatcaggaacccagtctcctcatcctgctcccattcgtaaatccaaaattgttgatgaaccactctcattcaagtaatcgacaattcttgataagctgccccttactgtttcattgaattggtttctctatttataaaaactaggagaataatatctttatactacataacgatcaaattcttaagaactatttatcaaccacaaaaaccaactaccaacaaacaaacaaacaaccatcatc

SEQ ID NO: 2026 - DNA, 500 bp, Peach associated luteovirus
  isolate PaLV RP19, complete genome.3
aacactgagacactgtccggatataagctcgggagactcgtcacctccgtcgtatcacttgttgttagtaactacaaatagcacctaaaaatcaaaaaaacagagtgtttgtttgcttttctgctcactttcttttagaaaatccagatcccactaccacaagtgggtgaaaaatatgggtagggtcggacttagccagtcctgtcggtgaagacactggaggaataccaggtggcgtcttctagggataccgattccggattcggagcctgcttctgggtggacactgcctcggacacaaccgagtgaacaaatggagtcactaaccacgatgaaatgagtgggagggtgaatcgacctcaattacgtcgttaaactggttggagttcctaactactcggaagttggggagaaagtcatctcaaaatgatcgttcaaagtcatcgagaaactttggcggctagggcttgcaattatggacttggcttttgcctagaaac

SEQ ID NO: 2027 - DNA, 501 bp, Soybean yellow common mosaic virus
  strain spider132820 hypothetical1
ctggatctttgtacctttgtgccacctaagctggtattggtttatctcacaacgcatgtccgacacagtgattgtaaacttttcgctgatccgaactcggtgcgtggaacgctttggcgtgaattccctcccagttggaagacatttcattggttcagaggagattcctacaggcatcggtttcgttgagcggtcttttcaggtcacagcctttgggaactattcagttcctgagagaagccgagtcaggttgatagactgcccagtatcgtgcgaggggacttttaagttcgatccggtacctttgtggctatctgttatctgtcgagtttgccaatctgaggctaaccttatcatcaaccaggagttggtgcctgggtatagtgaaaacagcaagttcgtgttttgcgaccccgaagggagacctttacggattagaacacgaagaggcgtccagcccagcagattttaccaccaggaagaaaagaccatttgtcagtc

SEQ ID NO: 2028 - DNA, 502 bp, Bremia lactucae associated dsRNA virus 1
  isolate DML-A_DN43224 ORF21
aacgaggtaagactaagagatcgtccgtagggagggtcctaagtcccctctttttgtctggaaaaattcccgatccagttctaacagagggaaataacgaagatttagttctttgtttaagtggtttttcaattccatttttaaaaattgaaatgtaaggcttggacttaaagtaggtatattgatttttgataggcggtcaatataatgaaataagttgattaaagtcgcaccccgaaaaatctagggggcgcccttttactactgtactaccgactacgggacgtgccgtccgaaatcttaagacttagcgccttaatcatttattgattggggaatcgcggcgctaaccagaaatggaggtgaaccacttaaggtgaggcgacagactgcaacggtagggcttacgacattgtgtagcttgaaagagtgaatttggatcgagccgggtattaggggacagtcggagggatttttaaagcgaaagcttccttggcgcgtt

SEQ ID NO: 2029 - DNA, 502 bp, Neurospora crassa fusarivirus 1
  NcFV1-JW222 RNA, complete genome.1
actggcacgtctacttgggtagcaagggagtttgtattcaatcccacccgatgagggttccttgcgtgcgatagcatgggaagtgggcaacactgatggagggaataagtgttgtctgtaaacaagactgcgacgggcataaagtaacctaaggtcggctggctatggtgattatgctaacaggaagggcaatgcctgggctgtggacatgcaatcagaaatggttgttatgtgcccgagaggacggatgcggcagtcggtcacccaaatgatgacgttaaactgggcttatggtgcaaaccgtgtcacagaggtatgagcacaggattggggacctggttagcaaaatgtgacaccgtatccccctgtggcgccgatcaagtcttaggacacaacaaaagaaacctaaaacttgctggcaccacgaatagtgttgtctagggcacaacacactacaagcgaaacacaacatagtactcaagagtgcacacacaaaacaagg

SEQ ID NO: 2030 - DNA, 502 bp, Oyster mushroom spherical virus
  complete genome.3
tcgggaagcccgttattacctttttacctgaattttgcggctggttgcttacttcccatggtatcattaggcacccctaccttttgtatgcgaagtatcttttccataaagaaaatggcaccttggccaatgttctaatttcatattacatggaattccaacattcgctaactcttggtgacgctctttgggaatcacttccgtatgatcttttgccctaccaaggccagcttcaacttctttttaatcaagctcgttctcgcgtgccttcctttctgattcgtgagaataaacttggcgatgctcctgctgccaagctttccgctcgttatgatctctttcgtcttccagctgattttatgcgcatggactggcgccttcttccttctagtattagacgatcacttctcttggctaggggtctgtaatgcctggcagcgttgtcatttcttctaatggaccccaattcttcatccaagatcatcgctcaacttctcgctga

SEQ ID NO: 2031 - DNA, 503 bp, Jogalong virus
  isolate P1-10 polyprotein gene, complete cds.1
ttgttcgcgtaaatcccgactaggcagaaaagtgaaggagtctgcagcgtgtaacgaccaagcccggacgaccccgttgaaacaggtgtatggtcatcgcgagacccggcggttacatgggtcgaatgtcaaggtgagttgacattctaaaaataaactcagttccaaaattggtagaggtttaggcagaataggttacacaacactgtgctggaacgtcgcctctaatgcccgagttcttagggacagtagacgtaagtcggcgagttgacaaaccagtggcactctttgctgtgttgtaaccctatttctggctccctcgttccgatggcggaagcctttttttaggcagccatgcagcacaccaggcggcgtccctcacacaggcggcaagagcaaaaatccttcgggtgagctcggtgtgcacttttatttaacagcgactatgagcagtttccttttgcagcacattgtgctgtgttgttcttggtggacttccaatc

SEQ ID NO: 2032 - DNA, 504 bp, Plasmopara viticola lesion associated ourmia-like virus 20
  isolate1
gagattagacgtttggcgaggttgtctcgactcagctttgttgagtgtaggagacttctcgcccttactgaaataagaaagtggaaagaaacaaaaaaagagaaacattggcaacgttggacttccctcacgtttgtgaggggtacttgtcccccgcttgcgggcatcgttacaccgatggaaactagtaagtagagcagtggagtaggcccagaaatagtcttggcccgtgtggtccgacttagggtcgctaccttttagcggcgaaaatgctaggaaatattttttcttgcccaagtgcgtagaatcgcgtgcttggggaggtggtcgtacttttgtattgccgggttaaccctccgggggacaaactaccaaggaaagagcctgaggtaaagaaggacgtaggcgtgtgtaggcacccgaacctttgtttcgatgagacaaaaaaaaagtgtcgtcctctacaggacaacttaaattgtgaatcgctcgattcgctttttt

SEQ ID NO: 2033 - DNA, 505 bp, Rhizoctonia fumigata mycovirus
  isolate C-314 hypothetical protein1
ctcgtccaaatcgcaaccgacgctgcttccgctgccgcccgcctcgctgatgagaacctcgctgctgtcgctgcacgcgacgaggctatagccaagacgcgcgagtacaaagcggaatcggctcgtaaatacccgggagcaccttcaacgtgagaaagatcttgagactaagcatgtggctgacaaggccattcttcaggctgagatcactgctctcaccgctgagcgtgatcacttcgagctggagaatgcaggtaatgaagcacttgccgctggcctcaaagcccgcatccttgacgccgtacgtgacctcgaatctgcacgagctgaagtatccaagcttaaggcagattcggctccattgctcgcccgccttgaccgtgcacacatcttgctcggcaagtactccactggctatggattcgctcgcccgtttgaagaggtcgtccacgctgaacttgaccgctccgacgacgagttgagtgctgagcgcaatgaagggtat

SEQ ID NO: 2034 - DNA, 505 bp, Rice Picorna-like virus 2
  isolate FYBPH-9, complete genome.1
gttagccacccacgttgttttttccaccagtcacttgactgtgtgttcagttagtatgtgattacactgtatggtatttctagttgcgactagaagcagtccattttcacatgctagccggaatgcattttcgagcctggtgttttactcttcttttggctaaagaaagaaaaccagttaggtgtgtttcagcaaccactatcatagtctgacttacatcgctactattttcagtggccttcgtaattttacgggccgcgctattctttgagtaggaacgtacgcctccgttagaaggctgagctcaaggggaacagggcatagccccggcatttttgtgccgctggattgtgaccccttgtgtgtaggttgacttaggatggtcgaattcctgacacgtatatcaaaacgtggccacctatcagatagtgatacgttaggtgtgggctgtgagcgcctgtttatcactttgccggcgggctaacgctcttcttgtcgcctgggc

SEQ ID NO: 2035 - DNA, 506 bp, Epicoccum nigrum mitovirus 1
  isolate CREA-VE-34SY2, complete1
ctcacgaaacctgcacccgggaaaaatccctttcgcagacgtgaatgatgataggatagttgttctagggaacggtagagtaagtttaatttcgaacctactccacttagtacggcttacccagctagtagcgctcagaaaactgtgaaaacaggactatggccactttagtttggaagttaatggcgataaagtatctactcccccgaaagggaagaagagacttttagccctccatactcactttatgtggaaattagcagcgaaaagtcagctatgggttaacccagatgctgctctctaagctaaatccaactctcagatgtagaccgtcttaacgatatcctttacaggacccattaatctggctttgatcaggttaaagtgatggtttccagaagatacagagttcgatacggggacagtgagacactgaccgagtaccaaatgctctagcacctctgaagtttaccaggagttcaaagcctggctacctaatacttaaa

SEQ ID NO: 2036 - DNA, 506 bp, Avian metaavulavirus 21
  isolate APMV/dove/Taiwan/AHRI33/2009,2
taatcacctatgccagttggttctagcttaagccaattattcactaatcactgctaatcatccatcatatgaagtgatcaactaagagagcgcccattaatcacatgtaatataaggagaaaatcctcaacggacaaacgaatcgtttaagggcttgaaccacaatcagatatcaagctacagtatgtcaaatcctatatatacattgtccatattgctacgtgagtccacactctattagctgccagaattcttactcctataataataccaagtcattataaatctgcctgtcaagatgatcgctcagataccacttaggttaactgtcaagttatcaaagtctataacaagcctgtctggatctgatacaaaaagagcacagattgtgatcttaatcccatcccttgacaacataaatctgattaactatgcatattcaagagaaattaagaaaaaacgggggggaatttatacgaattgcggtcacaaaagtataaccgagc

SEQ ID NO: 2037 - DNA, 507 bp, Agaricus bisporus virus 15
  isolate AbV15-003, partial sequence.1
ggttaccctgcggaagggtggtaaaagactacgggtcggcagactaagcatctgtaccgtacgacgccttcgtaccgtgttcgaaaagagggtggaactggatcttaatctctgagagaatccatgtcctcttagtagtaggtgcggaatatgccaagctctcctgacgtggagcagcaggagtggttaccctgttagggataagggatctgtgcgacccccccggcataatcgtttagagctagccaccgtgctacggaatgacgcaaagccattcatctctctatccgaagaaaaccacaaggttctcatttttatgaggcaacgacgtacctgagttcagtcctaggacaatctaatccacgtttggtgcagataagactgactcgaaactaagttgaacccactcgccgagctcttcaatgggcggcctaaattgatccagcctaggatcattttagtagtttaggcactacctccatcaacggtcgttttgccaagacctta

SEQ ID NO: 2038 - DNA, 507 bp, Hubei odonate virus 11
  strain QTM161788 RNA-dependent RNA1
catccataacatgttatatattctttaattatcatatatactcattagcattattacttgattgtatataaccatgtttttgtaactacataactctaaacctaaccaccattgtagctggtattgattcttgtattaaaagttcattaatttgatgtgtgtcttttattgttcacgctgttatgcaagactctgacaacgaggtaatggtctaaatgtgtacaaacttgatatatactgttcctcgtgtatctaaataattaaactaattcattatttccatttatgttgtattctctttagagtgtcaagtcattcaagtcaagcggtagcgggaagagatcaaagtcctctaaaactgtaaaatcagggaaaaagcagaagcaagagggaactccccaaagggttaccagatcaaacaaatttgcggaaagtgcaagtgttctaagtacacttgaaacgttatctatcgcagaacctcctgtatctgccgcgcaacctcaaata

SEQ ID NO: 2039 - DNA, 507 bp, Trichosanthes kirilowii picorna-like virus
  strain pt111-pic-51
ttttctctcatggaatagatgtgtagctctgagtagtggcatcgaaacccttgccgtaagttacatgataatttgaggctgtggctgataatagtgcagacctcttttaagtgtggactcgcaagacgatttcatgggcttatgcttaagagtagctcctgtagtagtgctctgactagccattgatgaaaccgatcaattattggggttgtgtactttacccacttaaggtacctgtggtaaggattagatggtggatcactaccggtcacgcctggcgagtaccaggtgctcattggagcataagaaagttgataggctctgtgaagcttgaaatcaaacccactgtgtagtgtagacaatatgtgttgattttgattatgatcagacatttaatctgtgaccgttgatacttcctacccactctaacggccttatgaactatatatagggttcgcaatcattcataaggttttatatattggattggctaccctacgatgcaac

SEQ ID NO: 2040 - DNA, 508 bp, Mytgal virus 2
  replicative protein gene, partial cds; and1
aggagcatcgagcttgagcgagctcgttaaatatacgctcacgggtggttccgtgcacggattctctgaattgtgcttcagacccttttgaagttccgatctttgtatttagtggctgtttgtatattatgcgttcttcaattgttatagccatatgttgtgctagtgctagatgttaggtcaaatttagcactttatcttatgaccagcaagtttaacagatttagaaacgactgctgacgttcaaattcagcagacttttgcttttgatgatagtgagaagcaatttattactaccgttagagacggtgaggacccaactcatgattggggttcgtactctgatgttgatttggccagatggcttgagaggcctattttagcatcgactcatatttgggaggtcggacaaccctttcctcagatttatttcaatccttggtcagcgtttcttgacagccctagtgtggctcaaaaactatcaaatttttatttgctccgttgcaag

SEQ ID NO: 2041 - DNA, 508 bp, Drosophila immigrans Nora virus
  complete genome.1
ctaggcacctgggcgggggttaatgagcactggaaataagaaacgcgagacaacgctttgctgattacgtataagtggagtatcggggagtaaaatcctgctgattacggttatatggagtatcggaagtggcaattgctataaactgggtccggagtaaacaggctgtttattaattttacgttcaaacctattgcaacaattccttacaacaacaaaaagttaaataggaaacttgaaaaattcctatcttaataaagtatattttgttttgttatcactacccgttttaattaataggctctgtaacattcataatagaaatatttcgtaatgataattctcatcaaaagatatcgatgtaaaatgtatctgtagctattcaattatattaattgagcttagcaatcgttaaattattataatttaaataataatttaatctcaatctagcagattgaaaaacacaaaagcataagtgtataaatatgcaaacgatggaagaaga

SEQ ID NO: 2042 - DNA, 508 bp, Hubei picorna-like virus 21
  strain WHBL73090 hypothetical protein 12
agctatatacgcacaagttcttttaaatgatttaaacgctcaatttggactagtggacaggatgctctatgcaacaagttgttactactcaggactttaaaaccagagaagagtgtttacacatgtagcttttgaacgggcgcatgtgaataaaagttcagcttctaatcaatctaacaatgtcataccagagagggatgctctggaagtatgtgacaatattacatcccttgctattgacggcgtagagaccacaggcgttactacgttcgctcaagaggcttgtgagcaagttgacgttttgggaaagttctatgttcctactagcgtagccactttgcagccggagttgcaggaccttaaagaatattttcgtcgtcctcgcgttattgcccagggtccttttacgcttaacacgcgtaataatccagttcagttgaatttttcagattctaatttcgagacgttctttccaggtgcacgtacgcgacttttaggggtttatggc

SEQ ID NO: 2043 - DNA, 508 bp, Wenzhou picorna-like virus 26
  strain WZSLuoII93478 hypothetical1
tgtgtatgctacaacatacacactcagtttaacggatctatccgttaaatagtttgcccacttctagtggtcgcttttcaccaggacttgatcctgtcgctttttaaacaacaaaccaatactgttttataatgacgatttgatattgtgttttagttagacctgcgtggttcattagtactgccttgcgaggaactggaaaatgaattactagtcggaccttttattaaccgctgcatgcaagttatagatcctaacacacaatatgcgagaaggaccaatctttggattatgacactgattagactgctggaacgcgtttcaggctctccgaaagatatagtacggagctagtgaaacaagtctttgtggagcgaaattatctctcactgggattggcactctcagaagcgtgagttcctttcacataagacgtatatctgggaagaaaagagcatcgataattggctctgagtttattaccagacgaaacactttttctgctatc

SEQ ID NO: 2044 - DNA, 508 bp, Beihai picorna-like virus 70
  strain BHBei76899 hypothetical protein1
tccgatctgcaacaacatacacactcagtttgacggacctatccgataaatagcttacccacttattagtggtcgctcttttaccaggacttgatcctgtcgcaagtacaaaatattattacctacgtcttacgatgatgatttggtattgtgttttagttagacctatatgatttgttagtactgccttgcgaggagctggaacgcttatcattagtcggaccttttattaaccgctgcaagcaagttatagatcctattgcacaatatgcgagaatgaccaatgactttggaatatgacgctgataagattgctatggccccgttctaggcccccgaaaagttacagtacggggctaatggaacaagtctttgtggagtgaaattacctctctctgaaattagcgacttcagctgcgtgagttctcttcacattgtacgtatatctaggaataagggctttataggccctgacgtagtactagacgaaaaactttacattgctacc

SEQ ID NO: 2045 - DNA, 509 bp, Aspergillus foetidus slow virus 2
  RdRp, gene for RNA dependent RNA1
gggatttttgaccgcccagatgagttttcatcgaaagtttgtcacacatgtttgatgggacacaatccatccccttatagttgactatgtactacagtcgtaattctataagagtcttgcctgctagtgggttcacactagttccgttgtagagtttctgggatcttcggattaaaaccccatacccctcgtaagtcaaaatagtttagtctcagccaagaaagaagctagatatactattagaccactgcgtgcggcactgaaactttgcagacaagatagtctgttttaaatcgacttattagagtcagagacgcctccgttttggcctctatgggtgatgtgccctgacacctccgtctagtcaacgagagtacaatcgcatcaattttcttacacataacttgcctgtttctgggctgccctctctcacgggccgaatatcatgtattcgaagtcttgtgtttgccgggtcaccaaaaccggctaggatttaactccgaaaagtt

SEQ ID NO: 2046 - DNA, 510 bp, Barns Ness breadcrumb sponge narna-like virus 6
  isolate L14,1
ttgaggaagagtggaagggtgaaccgaaagtttttacaaggttcaccccgtccttcttcttcctgcccgtggtcgtcagtcttggcagctggagtcacaacaaatgttgactccagtctggactggccacgctgcaccaatggtcgggacaggaagcacaattgtgctaccgtcttcgatgagctgtgcggcagcctcacccgtgatggcacgggagagggcaaattcaaccttcagaagctgagggctgctggcatccgtcttcaagacgttccagcctcccttagcaaggttgcatttgctctgactgcgcagaagaaatgtgtatgtcagcatgagtacgactcactcacagactcgctttactttttgcgggctctatgtgagaatcttcttgatgctgattcaatatttcttcgtgctaagacatccgatttcgacattttcttatccacactcttgaagttgaacaacgtggaaagagtcgcagccattaagtattggactgcg

SEQ ID NO: 2047 - DNA, 510 bp, Teucrium fruticans picorna-like virus
  strain pt181-pic-9 genomic1
tagcgcagacgcaaacatagagtgtgcaagtttattacttgcacactctatgtttgcgtctgcgctattcgaatctttgtaagagacccttattctggtttggaaacgcctgggcgtctgcatagatgtgcagtcccttttatggagcactcttatttattgcagcttaattctatgattaaatgccatcaagtctaactatggcattttacaactacccgtctttattgataggctcttggttatagaattaattaggcctcttttgatgaaagaataaatcatccgctatttataggaagcgaagaattttctatttatagttgtagtgtcattcctatttaggatacggttggacacataaataactaatcttcttcccagcactttggtctataccatctaccccttagtgttgtgtaaaattatggtggtcaaaataacatcaacaataaagaatctgatggttcccagtctacctctccatcacagattcacaatcccgataaa

SEQ ID NO: 2048 - DNA, 511 bp, Plasmopara viticola lesion associated dsRNA virus 1
  isolate1
aatacgttgataatagatactttctatgaaagtctccctcttttgcattagccctttcgtaactgatcggtctaaggcctgttcaaggctcattgagatctaaggataaaaattcttagaaatattaaagattatcgggggaagattgcgaggacaagtgcctaggaaacacttgaaacaatccttgcaataagaaacctacaaagctgtctataggtatgtgctcagactatagactaaagtataacactgctccctgagacggggggtgtgtccatatgggtaactgtatgtgatgctaacgaagccctatgcggattgcttgaagcagaagcgatatgatggatggtgcaaacgtgccgaaagcaaaattatttagttttgttattaggtgtaacgatcgcgtgtatactgaagagaagctctagccggtacgatctccttggacactaatgcctttaaataagttaggtgggggcgagcccctttggtactgaggccgcatgtaatc

SEQ ID NO: 2049 - DNA, 511 bp, Beihai rhabdo-like virus 5
  strain BHJP63888 putative nucleoprotein,2
aggcccagccttgcggcagggggtgctggcaccgcgggtattgctcttgctcattgttgaaaccctgccccaacccgctatcaaactgagtctcgtgaacttacctaggcaagcgagtaattccactatataattgtttagaaaatgtatatgtctctcacaagcttattgatgattgtattagagagacagttaggattgattatgtgaaattgagagcctgagatggcatatgagtcatctatatttggaaatgtattatattatcgcggttcttataactagtaggctgtagtgtactgtaaaatgtatgtttgtaggtctgtagcgaattgaagtgaatcaaattatgatctaaaaagccacttaccttattaatactggcatgaccacgtagaatgtagaacacatcatgtatatccataatgtatattagtacttaccttctgttgcttagaaaaaatcgacaaacacaacaacgtctcttaaccagactcacaggtgtcacatt

SEQ ID NO: 2050 - DNA, 511 bp, Harbor seal picornavirus
  isolate HsPV/WVL19023-02/USA/2008,1
cggggtggttggaactcacctgtacggtgagtgtctagctgccctgccccttcccctgagccggggttctttggctcgtccctgatctttttctatctcccctacttgtttgattctccccgactacggagctttttggcataaacttgttatcgatgttggattgtccgttaactgacttgatgggggacatagccccgggtgacctatgtcttgaagcgtttcctcacatggattcaaagtggtgctgaaatattgcaagcgtcgtttccatgtgtgtagacgtgaataggcatagttagcccaactgcaatcacctgaaagcccctgaggggttattaaggtggactcacaactgaagagctggagtgggcgctttacggtacatagcattgctctacctataggaagtgtctacatggctaagggtgggggcccttagcttgtccagtgctgggtgacagcctcgtgccgcgcgtcagtttgtgagtataagcggctgtaaaccgcc

SEQ ID NO: 2051 - DNA, 511 bp, Beihai picorna-like virus 119
  strain BHJP60437 hypothetical protein2
agaatgatgagcgcggaaaaataaaaatattgacatatccaacgtgtacgcagtaccattcgaaaactcgactctaaagttagaagacataccacgaccacgaccacgattttgccactattttcttttacaagcagcgtaatctagctttgcatttttattactattattgcttcaaattaagccattagaaagtaaatatttagaattattgtatctcaactctatacatggaaggagctggaattgttcaatactatcaggaaaccaaaattcattccatctctccagcccaggccacaagtctacaaaacgcgctagagggtttgacaagtaacagatcaattagggttagggtcaattctgacctcgacaaatacattactaatttcttaggaactcccagtccgggagtaaatcagtcaactgtgtcaaaggttaacgccagagcaagagcagaacttgctttgaactacgacccagttaggtggatcagctcctacgaggcgct

SEQ ID NO: 2052 - DNA, 512 bp, Marburg marburgvirus
  isolate Marburg6
gtggcttaaactagcatgagtatttccaggtcaaccacataataatgttggaggcacagtacattatagttgattatcctgtataataaaggatatacttaccctgatttatatttactggtataaaatagtagcatcatcttatcaactagttgtcatacaataggctgttcctataatctgatggtgaaagtataagcttgtagagttaccatgagtcacaactgttgtatattgtccaaaatatatcttgtgcaagtagtgtgtgcttgaatatgctgatgtaatacacactaataatgattgattaagaaaaatcaatgatggatattaaatgtccatcaagcaggtgtcgtaaaatattaggggtttcaaatgctgccagacttactaaattttacataggattatataattctcttcgatatacgttatatctttagcaaagtaatgaaaacagctttatcatgttagacgccaattattcatcttaagtgaatcctttcttcaat

SEQ ID NO: 2053 - DNA, 512 bp, Flen picorna-like virus
  strain SW9, partial genome.1
tttttttgttgctcgaccgcctaaacgaaggcaaagtgctcgaccctattgcggttgagtatattgactcagtgctagagcgccactttttgcgctacttgaaccgtctcaaccttacgaggtatgagaaactcgtgtggtccggatcatatccgtcctgcacgatcgagtacttgttcctcaaggctcgagcgaaattctatcatgacaatgatagagtctcgttctacgaggactgtcttcgccgattggaatcggctaacgtctactccgtcctgcatgacgaagaatgctctcatgagcccaccgttgacgtcattgagacgtgtgccgcgcacaatgttgtgcgtgttaaacgagtccgtcccgctatttgggatgatttcactcgtttagtggaagaacatcccgttcgagctcctgctcctattcgggatgctacgttgctgcgccgtctgcgtagtatcattagtggtctggtcgcccaccgcactaatgatgtttatgagggc

SEQ ID NO: 2054 - DNA, 512 bp, Guangdong spotted longbarbel catfish picornavirus
  strain1
gggggttgtgaccttcccttggttctctttggacgtaagctatacgatacatgcgctctttgttgtctggttttgtcacttttgttttgtgttatgtttccttctttctgggtgttctagcaccacccaagtcttagcgggttttccgattctatattaagacagatgctagctggctccgtattcaatccatctgagcctgtgtaaagttcttttgatttcttgggcttgcttacaccttgccaaaggtttgttttgagtggcggtggtttggccacgtggtgacacgtgcccccggacgtactatcgctatagtgcggaatctcattaaccaggaatagattgaatgttaagcaggaggtgatgttttgatgcgtagttgggcagctctttggacactagggaggtaccccttatgggatctgactctagggctatgaccatgatgctgcaaaaatttgtttccctttttaaaaacacacgaacacaacttaatgaaataacgatttgaa

SEQ ID NO: 2055 - DNA, 512 bp, Hubei toti-like virus 9
  strain QTM27092 hypothetical protein gene,1
gcaaataagaaacctacggcctacataaatattaatgcatatctacaacataatagacatcgcacagttgcgcttaagttccaggtctttgcgcgtgtggctaggggtcataatatgataggcattgagacagtccaccaacctatgtttgatatggaacgattccctatggtgaagtttggaacggtggttgagtatatttgggatagacatgttatacgagcagcggtgatagacaaaaatgattttgtcaatgagaacgacttcaatactatgcggcattgtgctatacaaagaagtcagtgggcaggaatttgtttgcccaataggtattatgctgtaaacatgaattttgatatgttgcctattttcgcagaactagatgcacatcgtactcgtgaagtacctaaaaatgacgcagcacaaccaccagctccagctgttgcagtggcagataatgctgaaacagcagaaatagaacagaaagcggaaaactaatttgggctaatgtc

SEQ ID NO: 2056 - DNA, 513 bp, Serbia mononega-like virus 1
  complete genome.2
tatgttcaatatatataatagcgcaagtgcctctctcttttaagaaaacccgccagtcatacatcaccagtgaatgctgataattgcaaggatgaataattccatagtagttttcagcattgtcctcattgtaggtttactcactggaggggtctttatcatgggtcggattacatccgcaggactccagttgtcttacacccctggctcactcttttattttgtattccctaatttttcgactatggccatagaggcttcattagtttacaaagtccttatatttttcgtatcaatattgatcctctctctcctgtcgatcatctatctgatgcacaaggagataatatctacgataagatgggctagtgaaacatatagagagtcaaggatgtttttgcaagcagcagcaaggtcagggcagtcaaggggaccactgcctgatttaatgagaccctaagtgtatggctcagtaatcttttatttacaaaaacccgctagtcaaccatcata

SEQ ID NO: 2057 - DNA, 513 bp, Tetranychus urticae-associated picorna-like virus 1
  isolate PK13,1
tttaaataagagtgtgcaagtaatacacttgcacactctaagttttcacatgagatgaccgattgtttggaattatatttcactcaattggaaacactcttgtgtgtctgcttagatgtgcagtcccttttatgaacacctcttatttaaagtattcatttgttagaatttatacatgcgccatcaagtctaaccatggcgtttgttacaactacccgtttgttaaataggctcttggttttaacatttgaatgacccctttgttgaaaggataaatcaacctctttcgtcttgaagcgtggagtttcaagtgaatgtagtagtgtcattcctattcaggatacggttggacacgtaaataactaatcctccacccagctctttgaactataccatctaccactaagggctgtgtaaattcatggtggtcaaaatgataatgaaaataataataatcatgattcgaatggttcccagtctacctctccaagttcgattcataaccccgataaa

SEQ ID NO: 2058 - DNA, 513 bp, Beihai picorna-like virus 18
  strain BHSC157282 hypothetical protein1
cgcaagacgcatgttcagtattgtttttgtatttgtattgtaggtctaagtccttggactttgagttataattttataatgcaaaatctttttacgggtgagtaaacacctcctttttggtaaaaaatcaatcatatttaatgatttaatttagtcaccttttaggcgatactgcatattgttccagcaggatagtattactattgatagtaatagttctactattgtcgaaatgaccgtatgtatagtacacatcactataagaaccggtaacctttatggtaagggaacacaggaataccgtttggtacccatattccacgcattgaagacaacctcattatctgatgatatgcgtgtaggagtttttctttcctccttgtttataaaaacctcactgagtcagttccacatctgttaaaaatgtgggcacaactaaagaccgagttgtgtagttaggccttttattttatttttattggaagcaatagagcttcccagacaaattttaag

SEQ ID NO: 2059 - DNA, 513 bp, Wenzhou narna-like virus 7
  strain WZFSL82100 RNA-dependent RNA1
gggaataaatattccttacacaggccttaagccttctagtttatattgtactagatctattccggtatagtatagactttaggtatgatagcgaaacccgtgagggtacgtttaatatcatagaggtctatcttcagatactacgccacgtatttggaggctcataagttcttagggcttacaaccctacggtctttggcatacattgtaaaattacaacataagcttagatcgcagttaccagcgatatctcttcggagaaaaggtaacagaactgtggtgaacgatgttaacaacgtagttaacaacgatgtcctttataaagagttcgtaagatcctttggtaagatcttacgactttataaagattggaagtttgtccaaaaatttgctcgtcggattgaaaagaattacttctctacaaccgattacaaattgaattttggacagatcccaagcgaccgagccattaagcgtgtgaagaacacgctgtgttggtgcttttcatatatt

SEQ ID NO: 2060 - DNA, 514 bp, Fusarium graminearum hypovirus 1
  strain FgHv1HN10, complete genome.1
cacagcctgttaaatccttcaggtggccccgtggggtctaaaggagtggatcgtcctacactttcagtaggcttcaaattagacgtgttactgtctattgaaggtgggtaatttaccgatccggggctatgcccgcgagctttgctcgagacaattgtcgtgcgttccgtgcgtgaggtttcctcgtgctttagagcgtgactttgtcatgttataatagtcaagttgtgttacgcatattaatattaacacaagatgagtcccattctagcagtcatgggaagcgcatttcaaaagaatgctgtctaggctggaatggaagaggccagttggggtcttgacttgggctgtacccaagaactaaccaggattgatagggtcaggagtagggtgtgttctaaccaacatcatctcctatctagtcaccttgaattgagtgggtaaaggtgacgaataaattccactctccaaaacaaatagtttgaaggagttacctgccgtctcccaaaaaggc

SEQ ID NO: 2061 - DNA, 514 bp, Botrytis cinerea fusarivirus 1-S2
  complete genome.1
tttggtgtgacaaatcaaccctgaaatagggttgacgactcgacacgacaacagtttcttctaagttgtcatgatttagtaagtctaaaactgttccacaccgaatttcaaagaaattttgaaaaacgatacggaaagttcttgaattggacaaggcttttcctgtcataaggcaagattgtgcttgtgtgcgctctgaccgaaccggtgggcaaggactggagcataggaaggaccatttagtatgggcttagtcgggcacaagtgaaccgtggggtccaaaagactgcttaccggcttgtgcttagggcttagtcctgaaatttgcgtagtaccccagcttctgttcttacctacttaaagggaaatagacgtggacactagactacatggaaagacatgttgacacagaatgaatagtattctacaaccaacaaaactcaacatttatgaagacaccagacaaacctgaacaagtaattatccgacacccatttagtaattttagtgaaag

SEQ ID NO: 2062 - DNA, 515 bp, Lentinus edodes dsRNA virus
  RNA-dependent RNA polymerase gene,1
ctaaggcaaagtccaggcacaaaaagcaaaagccgagagctcatcaactgaacaatagatgcttggattccctttttgaacatgaatgtatattgtgcactgatcagatccttgttgggccaaaccaaattgtgattgaccaggataatcacctattccgtcgacctattccatcgacctattcgttttgctcattgttcattctgatcgaggctcccgcgtaccgcgttgtttgtatcggtgtacgcgtccgtgacaatgacggtcaagcaaagcgggccttctataaatggtacttgagcgtactttttccctctttgaaacccacgaacgtgactgagacgacgagcaaacggtgcacttacctctagtcgctccagtgcatttgtgctttcactagacgttcctcttcttcctacgcgctatcttacgggcttcttcgcaatggatcacttccaggctcatgcgccctgcgttgggagctcttccgataacatccagcaagccgatgtgga

SEQ ID NO: 2063 - DNA, 516 bp, Wenzhou picorna-like virus 2
  strain beimix73672 hypothetical1
gtgtgcatagctatttacttagctatgcacactacattggtatttgtcagtttaatgctgacacattatgcaactacacagtcgcctttatgatatttatcgtttatcagggctactacatagtcgccttataaacttcaatgtttatcatattgtatgtttaattactgatacttttaccggcttaaaagagccgccgacatttatttgtccgaaatcttttttcttttttggtacgcctgttgaggcatttaataccaaaaccattttcaaagagaggtacgacagttctctgctgtcttactctataaaagcctaccccaaagagtagaacttgagggatgatatgagttttgcgctacttgactgcgcttattattaaagcgtcaagccacaacctacctgtcagttaattttcatgaaattattcggcagggaaccgtagagtcgcgggtgccacgacttgaaaggacttgtccttagcatgcaccgtacaccgatgaaccttacgaggtg

SEQ ID NO: 2064 - DNA, 516 bp, Hubei tombus-like virus 1
  strain SCM51273 hypothetical protein 1,1
gggtactagacccgatgacggaatttcgctcatgccggccctggccggggggggcagacttcggcgcacgtagacttcggtcgcggactggtgatatgcgcaagagatattctagttaagtcctagtggcaatattgtcccgggtgctgccctgattatagcagccgagtaacctgctcgatcgttaagagaaatataaggaccggaccgcaagtaggggtcatgcataccgtcgttggatatgcatcagcccccacgtaggctcgacggcgcaccacgctttaaaatggtctcctagctggagtgtacgctagtggcagcttgtgtaggcttgttgtcgcgaccacataccctggtccttggtacaccgatggacccctggccgaggttaatggcggccccgcagggcagttaaatatatgcaggtaagctccagccttgagtgggccggtctgacatacgtgagtccgttcgtgcaccagcgttaggtgtacactacccccctacaattacatc

SEQ ID NO: 2065 - DNA, 517 bp, Mayfield virus 2
  putative non-structral polyprotein gene, complete1
gtacaggcgcatctgagagaagtgttattcgcagttttacgtactgattacctggatcacagattcacggaaaggtcgttgctgtcataatagtgcataatcagagtttattgcaaggggaacgagagtgtaaaggtttacaacggttcgcccgaggtgctttagttttgtgtgatacacgctgagagaagctacatcagtgacgagttacggagtaactggacgagtattcattgaaacggctatatcacggtaaaatacggtgtaattgttgtgtccattgtggaccatcgagaaaagcggtatttgtgataggtcacggagtaaccggatcggtgtccaccgaaacggctgcgttgcgtagtatatagtgtaatcgtgtgttagtgtttattgtttatcattattattttgacaatattcattcattatttagataagcgttatcgtgcattagtatatcgattttagaattattttatattttataggcgattacgagcgttaagcccgcaaa

SEQ ID NO: 2066 - DNA, 519 bp, Yili teratoscincus roborowskii picornavirus 2
  strain LPWC2102151
ggtcggggagatgtgttcatgatcggttaacaccatcatggatcatctctccccgacctctttttgacccagctatgggttaaatagtacttttcttttctcttttgctttcttttgtgttttgtttgttttgcaacatataacaagcattttatcagtattagtgtctgcaactgtataacaagcaaggtggagcaatcatgcgagtatatctcaattgaattgtgacacacaagtgtgcactatgtggaataaatgccattttggccaaacctggttagccagaccagtagtaggacaatttggcacccttagtgggcgcgacctagatgctagggatgagcaaacctatttcccctgagtacaggggctctccttcacctctacattttggacctctttttgagtatcctcgatagaaggtgaagtgacggtgtaccggatggttaattgatctcattgctgggtgacagcccgctaggaccaggcagcatctttgtatggacctgtacatgtaac

SEQ ID NO: 2067 - DNA, 520 bp, Wuhan insect virus 14
  strain WHZM10168 polyprotein gene, complete1
gttgaaatccttacaggtgaacccgtctgggtcctaaggagtgagttaccacgctttcagtggtttgcatttgcggtagtgatgtgctactcgctgcaagcggttatttcttttaactcgtgcccttctcgtgggcgtggaagttatcttccgtgatcttttggatcgtggtttcgtttgaaaccgtagctacttttgtgtagctgtgacctacttcaggttgttaatttgtggttcgcctaccacgtagtgctacggcactgtacattctttactccgaagagtttaaactactatgcgtgttggtactcgtgatgacactgatggccgtgaccgtgtgtcaattagaggcttggtctatatctgttgtaaggaagtacctacgaacagattctgtctcggaagacctttattataaatttaagaccttcaaaaccataggcttaaaccatcgacccaaagacgctttcgaatgtgtaccacttcaagtcaatctttggtagggaggttataaatccac

SEQ ID NO: 2068 - DNA, 520 bp, Lasius neglectus virus 1
  isolate Cambridge-Lne, complete genome.1
atcctgctgctggaattcaggcagctacagcttctacagctgaggctggtgctgttgcaaataaagcggctgatataacaactggagttgtacaaacagcagagggagtggcaggagctactcctgttggaatgatagcgttgattaactcaatgcttggggatgcaactgcagctggtattaatgcttcaaaccaaaatgcaatttcaaaaaattatatacagaattctatggcaaagggatctcaatctggttttcaggctggacttattaaagaatctgagttagctcatgcatctgtaactaatgcaggagctaaaataggaggcatagcaggcccattaggtgcttggtttggctctttgatagctaatgcaattcaagattcaactcctaaggatgattataataatttcaaaacaggatattcctttgatggcaaagttaatccgcaagatactggtttggttggctcaggaactactgctgacctctctggtgaaactaacatgacaacatt

SEQ ID NO: 2069 - DNA, 520 bp, Wenzhou picorna-like virus 22
  strain WZFSL83961 hypothetical1
atcccgctctttagtgttagtacttgttacacactaaatcctattatctaaggtcaatgtgaacatgtttatatgaatgtgtttgtgttgcaaagtgtttgtcttaatatgatgaacattttgtgattattattgattattagttagttattgttagtttatataaacaaacattaggtttgttagttagtgttagctttgttttgagctgctcatggggctcacattcgtctaatgccgctatttaagtttgaggtacgttgatcgtcacctgtcaaccgctgcctattattacttctacacatgcgagaatagcgtttcccgagtagtgttgacgtatgtttgtttgtatactaacgatgttttttattttgttttctagtcctggtgtgtacaggaattcatcgcaactgtatctttgttaagggtacagcaatatatattatagtcaacttccgtaagaaaaccaacttcagcacatcccaattgtgctgtcgtaattttggaggaacactctaac

SEQ ID NO: 2070 - DNA, 520 bp, Wenzhou sobemo-like virus 3
  17CxIT-T2-F3 genes for hypothetical1
actggaatgacgaagttagctactcccgagaatccatgtcttatccagaccatggcccggtagagcggcctgctgacgttatacgtcagcaagggacagctcccgtgtcaacgtcacctacagcacaggccactcctatggccccagcgacatccgcgcccgcagcgccagcttcgccaaccccttcccagccggagggaaacgcgagcagggcctctgcaggtgcggaggcccgtggcaacgccagtctgcaaggaaatgcacagagcggaaacgcttcagtaagccccgcgtcagcaattcctttggaacagcaggcgacagctaccaatggcccgacatcgatgcctgctccgcgaagcgtagcttccgtctccacgtcgaccgatttttcgcggcgcaagcaaaccgcaaagctggtccgattggaacccggagcatcgaccgcgttgagaagagatgccgtagctggaagtgctcagtaacccgctacaaagattttgaagaaaactttgaaatc

SEQ ID NO: 2071 - DNA, 521 bp, Ruddy turnstone calicivirus A
  isolate MW19 genomic sequence.1
catagctgttatgctatgtcaaatcgaacctttaacatctagttctcactatctcgccttgggatatggcttcggccctctatctcacggttaggtagttctgactgattttttgtttacgactttcttggcttttgtctttaaaaaccatgtgtaactgtaagtgcccttatcgacaggacgcgccccacgtggaattggggaaatctggatcatgggattccgcctgcagtacggaaaagtaccgagtacttagtatgttctgtagtgccccatgtgaagggaccgcctgagctagagctacgggcttggaaggtaaggtaggacgcctttttggctatcctacgatcgtccggcgccgattgcgtggcctcgtgcccctctccggttccgccccgatgatgcaggatttccgctaggggtttgtgacgcctccaggtacgtgaggatgggaagcctcaccaatgcgtagtgctgggtgacagcctgccggctggcgcagttcagtgtggtatagccag

SEQ ID NO: 2072 - DNA, 522 bp, Marmot picobirnavirus
  clone c207479_g1_i1_libraryC_2529 segment I1
atttattaatttatcaacacagaaaggaggaatctattgtggtttgtaaaatcattaattcaaaaccacatagtcactcagtaatcgccaaatcacagtggatgctgtgtactttagcggttgagtgcagaaaggaggtatatcttgacagatatacaaattaagtactggggtctcaaagaaaccggtcgtcacaatctcgctggagaaagacaagcggctaatgaactgaaagagactcacagacacaatgtcactggtgagaaagaaaccaaacgacataatcaaacctttgagggtgagacaaagagacataatgttgctggcgaaagagaaacgcataggcatagtgtcgtgctcgaaggtattgagaaaggtaaactcaaagaggttactcgacataacgtagcttctgagagaattgattctggtaaattgtccgaatccaaaagacataataaggttaccgaatcaatccagcagcaagatgcaaatacaaggcttcaagttgcttatacccaa

SEQ ID NO: 2073 - DNA, 522 bp, Swine hepatitis E virus
  strain HB-S3, complete genome.1
gcccggcactctattgtggaacaccgtttggaacatggctgtcatagcacactgttatgagttccgcgacctcagagtcgcagcatttaaaggggatgattccgttgtgctctgtagcgattatcggcagagccgcgacgctgctgccttgattgctggttgtgggttgaagcttaaagtggattttagacctattgggttgtatgctggtgtggttgtggccccgggcctcgggactctgcctgatgttgttaggtttgctggccggctctcggagaagaactgggggccaggcccggagagggcggagcagctccggctggccgtttgtgattttctgcgaaagttaacgaatgtggctcaggtttgtgtggatgttgtttcgcaggtttacggtgttagccccggtttggtacataacctgatcgggatgcttcagaccattgctgatggcaaggcacactttaccgagacaatcaaaccggttcttgaccttactagctccattatatatcgggtgga

SEQ ID NO: 2074 - DNA, 522 bp, Blattodean phenui-related virus OKIAV267
  segment S cRNA sequence.1
gccttctcatttatataagaactcttcagtgatcaaaagatgtcagcatctgtgtgatatagcagttggactggaatcatttgctggttcagcaaaggagacgaatccagtttttaaagattaccatggtctttttcacataaataaattacctgctatcaacagcctggcatctcatgttccagagagtatcgaccttgctttcaaactaaaacggaggaaatttattatagagaaacttcatttgccaccagaacttcaagagacaacacaaagagagcaagatgatatgccttctgctagagcagttagttgtggtgttggtggtgggacaagaaatctggatttttaatattcttgagttgtctggtctggcattggttgtactgggtgccatactgctaactgatgtccccagagtgctgttgtcccgacttttaggctccaatcacacatagacggagaccacatttgaaaaataattactaatctcgtgtgaaattgtaattagcaatcatcaag

SEQ ID NO: 2075 - DNA, 522 bp, Wenling picorna-like virus 9
  strain WLJQ104209 hypothetical protein1
ggggaacactttcccccatgctctattttaacctcatatacgactttgtatttattaaaggatttggatcgcaacggtcctcttcttttcttactacaaaactcgtatatgttgtatcatcaatcttatcttttcattacaactttacttatcactttatcacaaatttatttgaatgttaacttctcgaaggtatggcaaacaagaatgtgtgagtgtggtttcacgaataaagggtattaggtgcaagaatagcttaaagtatatgcttttaaaacggcctctatacacctagtatactggagtatttaagtatcaaagggatatctatgattataggaaatcgatatcaactggtgctgcttacttactttacgtaatagacttggtaactctattataggtaaaactcacggaacgctggatttcttaatggattcgagaacggacacatgatagtatttaacatcgatatgagacatgaattacctcatatcatcataattttcacttgaacaaacc

SEQ ID NO: 2076 - DNA, 524 bp, Wenzhou picorna-like virus 28
  strain WZRBX42853 hypothetical1
atacaactgaaagcagttaaccccgattgaacgtcttgtccacgatacgtgacctgtgaccgagagaattctactactttgttttcgcattccgtcgctattattttcctatttaaagtaagaggttgcctagagcatttaccaggactctgttaaatagatgagattttgtgtgttgtctaacaaaacactcagggccaagtattccctctaaaatactaaaccgtcttaagtagtgagctatctttgattgtattgttgattatcaaccaacttccgcctttgattttagcccgcaatctgaaaggttatcagttataaaacctccgcgatcgacgactcaagacttgttcctctgttggtactcgattcgccgcccctattgcgagaattagaagagatagtcccaagctaatctactttgaagaatcattgtgatctccacctgtacttgataactaccagtgtattttgctttgattgccatagttgtttatcgattaaagtcctttaggtactcaacc

SEQ ID NO: 2077 - DNA, 525 bp, Changjiang picorna-like virus 13
  strain CJLX40994 hypothetical1
agcgtgcttaacagcacgttgaaagtaaattgttcgaccagagcatgcgtaaaactgatgcctcttttgaggaccacaatctggcgaagagtcatattgaagtacctctaatcagtgggaggagcccaatagcgattctttttagataattgaaaatggactttttatctcgcttcttcgcgcgagtaataaacacgaagaaaccaaaattataaaatttttaaaaatagggtcgcaggcttgttacctgcaaacacattatttagaccccccaaaaatagaagctccgtagtttgtccgaattgcggctcacttggtcattaagaagattccctgaaactccgccaaaagcgattgtaacgtaaaggaattatttcgagaaaccgagttgaggtgtgagataacgatattctatgccttccttcttttcccaacaagaagataaacatgttgaggaccttctgaagtggttatcttcagtgacagggtgaaagcacccaatccaaatttaacattttcttaatc

SEQ ID NO: 2078 - DNA, 526 bp, Bole Tick Virus 3
  strain 15-CYL glycoprotein and nucleoprotein1
cgttagagatgagttagacggggttcttcagaaggattcagagaaatttgcgtatgatactctgactcatgtgctccacatagtgcatagattagcaaccatcgaaggattccttcttattgtaacacttgttcaaaaaggtgaagtaagcgttacagccaaacactgtaatgacggctataggagcttcatccatagcatagctcagcgagttgatctgagagccaacatggcagaacatcctcagggtgcctttgagtacaagggagagaccatacatcctttcaagcattggaaagtagggatgagatggggtgtccaagcaatgactatttcacgtcgcttgtgaggatactgatgtatatatgtaaatatatttagcattagctctgtaatcatcttatcttatatccatgtagtcaatattttatgcatatctcgttcatattcactcactgtattaaaaatggagacaggattcaattgatcgatttttgagcagatacactcttcctcagagatcatc

SEQ ID NO: 2079 - DNA, 526 bp, Beihai razor shell virus 2
  strain BHBei76898 hypothetical protein 12
gggcgtgacctacgtcctggtcttcattgaccgcaccaaaaggatctatatattgatctttcacgaatatgacggtaattgtgaagtgctatatatagtaaagttattagcgccatgtgtaggcgtgaacgcgaccgtcaataacacttcagcgtgcttgagcaggcatgctgtcgtacatagattgctcgccgctatcaataacaataataacaatgacaatacgcttgttggaaatcgttctgccttagaaactgaacagaataccacatttgtagaagacgcacctcttaccattacaccaaatgttgtagtgacagattccacttttaatgacggcgctgttgacaacgtggctttgggcgactggttctccagacccgtacatgttgccacatatgtttggaatgagggtgcactcttggatgaagttctattgccttggtatgagttttttaacattttaaccatcaggaataagctttttggatattcacgtttgaggtgcaaccttcatgctaagttc

SEQ ID NO: 2080 - DNA, 526 bp, Hubei tombus-like virus 18
  strain QTM27278 hypothetical protein 1,1
cggaaatgcaattgatcaggactgccgagtatataccaacgcaatatcggttggataggtttaatgagtttttcaggactggggacagcagctccagcgcggctactggccccaagaactcactaaacaaagtgaatgttgtgcgcaagtgcctctcaaaacgttggatagtaggcataggattattagccatggcaagcctggtcattttgcgaaaaccgcagttaccgttacatatcccaacattatcgcgtatcatgtaaatactcatagtagttgttattgtaatgaattagttagtatatataatagacatttagttgataggagttatattaaatatgataagttagctataagtaagggctttgggttagttgataagttttatagcaatgttaaggtacataaacttagttataatgatatcataggggaatatactggtagtaaacgtaggttttataagcaagcattatataagttaattaatgagggttttcagcgtaagtttagctatgtgact

SEQ ID NO: 2081 - DNA, 527 bp, Trichoderma atroviride mycovirus
  complete genome.1
tttggaactcagctaatacactggtggctgagctgaggttccaccatctaattaaactactcaaatataccttcactaggaataataaattatatatatccctcgtggacgtgattaacgaagtagcaggccacacctttaaattgagctatttagatgataaacagaacttaaataaaccgaagtttttctttgattacgatactgttgcgcgtaaacacaactttaataatgaacctactgaaataaatggcgcaatattacgctggatcttcctacatcccactcctccaagtgtatatgactacttaccaaattttaatgaagatatcagattagaggattccattcaagttcttccagcacgatcataccttaatctagcaagtgtgccgtatgttccaccagaacgtttaggtgacactgactctaaaaatgagtatatagaacttgaccctcacactgtgggcatagccgttaagaaacagaattcagtactcatagaagaatggaatttttatcataat

SEQ ID NO: 2082 - DNA, 528 bp, Venezuelan equine encephalitis virus
  strain 69Z1 structural1
gatcgcaagcagagtgttgagagaacggctaaccggatcaccatgtgcagcattcattggagatgacaatatcgtgaaaggagtcaaatcggacaaattaatggcagacaggtgcgccacttggttgaatatggaagtcaagattatagatgctgtggtgggcgagaaagcgccctatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgacatagtctagtccgccaag

SEQ ID NO: 2083 - DNA, 528 bp, Yongsan picorna-like virus 1
  strain 16-0061/ROK/2016 putative1
ccagtaggtctctaatccgatccaatattaccgcgcacaaagtcgaaaacagccttataacaagactccaagcacttcttcttcgagggtccaacttgttttatatgaaacaattgtacctttccgacgcgccaggtcgaattcggttattcaggaaactactacaccaccgtcaccgtgttcaagcgagtcggaaaggtacaattgtttcatataaaacaagttggaccctcgaagaagaagtgcttggagtcttgttataaggctgttttcgactttgtgcgcggtaatattggatcagattggaagacgcaaggactggactccaataagagcagtgatttgaatgctgatgtcgaggataatgtgcaagaggtttcgaaggaagagaatgttatcattgagggagcagaagtgagtactgttgcaagtgttccccgatcccaattgcgtgaccttgtggctttgtcaacaacagagaaagtttacacatttgctgattcttcttcatctgtagttggaagatgg

SEQ ID NO: 2084 - DNA, 529 bp, Unknown
  Description of Unknown: Bat dicibavirus clone Bat/CAM/DicV-P2/2013 non-structural1 sequence
acgcatccctccatgcggggtcgatctgcatgtaaaaccaaatccggctatgtttgtatggttacgcacgccaatagaaaagtttgttcatttatcttttctggtttgacgcttcttacataagactgttgtatggcaatccttatttagggatgggtagtcgcccgcaacaaatgatcataaattgtaagattgagggatcttgcgatatattatttatccccttgctcaaattacaaatgtaacgctcaccgagggagcgcataaatctcgggaccaaacagtgttgtataacgattatgcaaataattgggagtacggcgtcgacgcagcgcaagacccaacgtactcattgacggatctcaatgatgcatcacttgaacattttttctcacgcccagttaagatagcttcttataactgggctacagggactgctttatttcagtccgttaacccgtggactacgttttttaataatcctcgggttataaatcgcatttctaattttaaccttattaggtgtaaa

SEQ ID NO: 2085 - DNA, 530 bp, Robinvale bee virus 6
  isolate VN1-8 structural polyprotein and1
ataaggtaagttaattataccttgtactttattgattatttgtatactatctccattttaaattattgatatgttgtgtgtgaacccatattgatatttaaataataaggatagatatactataattgatactgtatgtaagatttaacgtttaaaattatacttatcttttaaaacacccaaaacttgtatgaaacgcaagtcaatcattcaattagcaaactacccgtatttaatataggctctttgttgattgagtaattgttgttcaaatgaacacctatttaagggttgattaatttcttaatgtgcgtggtggcacctttaaatagtagatttccgtctttctctattcagagtacttttggacgttaactaatgctccatccagtcttgaatgtatgataattaaactcaagattgtgtaaatttatcttatcgcaagtacatcaaataaaatttatgaagaaccagcaaaactcgacgataatttcgcccctgatcttagtaatgtaacaaatactaatttt

SEQ ID NO: 2086 - DNA, 530 bp, Picoa juniperi megatotivirus 1
  isolate ANK_VIR-88, complete genome.1
acaaaaccgtcattccaaagaggaagacaacctcactaaaaaattacaagttttttagtttgttcgagaaacataccggcgaaagaaagttgggaaagtttctacttgaacagacggaaaacacatataataataaacgtaaattaccagatgcgattgactgtttcaaaactattcaagagatattacaatctgttgatcagcgaagaatcggtattaatccaactcaactggaatattacaaatcaaccttaagacaaaaattgaacggctcattgaaccgaccatttatcgtagcccatagtggtttcggtaagacgacgctagctaaggaaaaatggattttggatatagatgattacatcccaaaagaagtatttactgtgcaaaactcgtcaacttcggcgcctgagttgattcttcaaaacgaatatatttttaactacatatgtgcatcatctggtgtaggtaaatctcacgttacaaagtttcacaatcaaactaatgtctttatcgatatcgatgaagtc

SEQ ID NO: 2087 - DNA, 530 bp, Hubei picorna-like virus 73
  strain WGML140238 hypothetical protein1
tgatatcatggcagtggctgcggcagcaatgtttggaggtaatgtgttgcaaggtttaatgaactggggtatgcagaaagatgttaatgcacaacaatttggatataatacacaactcattaatcaacaaattaaaggtcaaatggcagtgaatgcagttaattatcaaaatttagctaattatcaacaaacaatggcgagatcatctggtgctccagcttatatgtttggaggaatgtctagtgggatgactcccaatattgggggttatcatgtaatgaatacaggtggtggtgcaaattttatgactggtaattttgcgtggacaatgcctgttggaggtatttctggttatacaggacaaggacgagcaccatcaactgcagatgttggtacccaaatgggtggtatgacggcgtcaactggaacaaatccaatagaacaccaagattaaaattagtctacctatggttcctaattcgataatagatggcagcaaataaacaagaaatcccaaaaagttatttatc

SEQ ID NO: 2088 - DNA, 531 bp, Sour cherry green ring mottle virus
  complete genome.1
atgagccttaggcctccaacggattttggcaagccattactgtttgcggctgccggcgtctctttggccctgctcattgcagcttacaaaagtcactacttaccacccgtaggcgacaacattcattctctaccacatggtggtcactactcagatgggactaaaagcataagctacaacggtttgaattgccaacagaatcacagccagaacctcttatcaagcaccagcaagttgatcccgcttaccttagttttcgttgtgagctttttgatttatgtctccagtaaatttggcaataggtctcctagcattcagcattactgcattcatcatcgctagtttcaattcaagtcctagtaatagttgcatggttttgattactggcgagagagcgttagtcaccggttgtgaaataacaccagacttgtctgatcttgtcaaacagttgaagcctcattcacatagcttaggtttttagcactaatactgatttgtatttgtgtgtgattagactacaattcattttaa

SEQ ID NO: 2089 - DNA, 532 bp, Carnation necrotic fleck virus
  Dc genomic RNA, complete genome.1
aacgttgcaatcaagtattgtataccccgattcttctttcgtgtttgcagatggtagctcactttcacccagtcaaatgcgcgcttctccttctcaaagcgctgaaagagagtttgcttaccttctacacagcgaaacgctttttaaatggtgcgcaacctgcgggccttcaatgcggtctgctctcagtgaaattaaccaactcggcaaatacagagaggatgcgaatatcgaagtcgatcttaaaactgtcgggtgtaagtatacaatcgatcgaattagagatttccttaagaatagcaacgactcctcgaacgacgcggttgaacacagctggagtttatctaactcttgcggtgaattagttgatcccagtgacatttcgcgttttaagaagctggttttcggaacgtcatcgtctgttgacaacgatgaattcactgctgtaacccatattcgggattatctagcttactgtttatctttagtcgataggtttaatttaccctcgcttaagggtgagaaagaacta

SEQ ID NO: 2090 - DNA, 533 bp, Le Blanc nodavirus
  strain JU1498 RNA-dependent RNA polymerase gene,1
tgtaaagcgccacggcttcgccgtttagctttccccttttggttagagcgatgtctatagcttgttcccttggttgcgggtaacgtagtgatggcaaagttggccaactgggattactggcgtacgatgtaacagctggatcgtactgggctctgggatcgaccgtctctcttgaggatgctgcacgcttcgcgcgttagggctagagagagcagctcgtctagtattgtgcaatggtcttgccttgctagctaaaaccaacccgaatttgatagtacgtgaacgcccgcccattcatagcgacaatgataaactttcaagccctaatcactcttcttcttcgttttgtttccttggtttttgatttggcattcttagtgcttcgttatagttttaaggctcttatagcccttattaggcttggttggctccttttgcgcctaccccttcaagtttgtctggccgtagctcttttggctttggccgcagtgatctcattagcaaccgcccagcataataccagctggactgac

SEQ ID NO: 2091 - DNA, 533 bp, Drosophila unispina virus 1
  ORF1, ORF2, ORF3, glycoprotein (G), and2
ccttaaaaacaagtataaaatatcagcctattaattacctatataaaaattataactaaaacattatattatcagcaatattaaccccaagaattaataatcttaaatcgtaaacatataatcttaataaaacccgttgagtctagtcacatatctgtaataatacccaaaattaaatactatattaagaaaagagaatgtatgagactaaaatcatgtgtccctattgtggaatgatgatcaatgttaggataagtactaaaactgatagtaatttttcaaaaacattagtcaattgtaggttttgtaaagaagaagtaaatatagaattagtcacaactgggaccatagacagtaaagagccagttggttcaaacaaaacagacaggtaagaatcactcctacattatggtataaaagatgctactagaattccatccattttcttataaaatctttaatcaataaaattataatcaagttaatactaaatctttgagtcttgtcacttacgaatagaaaaacccgttaag

SEQ ID NO: 2092 - DNA, 534 bp, Cymbidium mosaic virus
  gene for coat protein.1
ctaaggccactcagcaccttcatcgctctcacccgcgccaagggcaacctcaccatcttcgatttcaatgccaggtttagttccaccgcctgaccactccaagtcactcttcgtccttgctattggtataactgtggtctccgcactatttgtgctgaagtcccacacgtttccaattgcaggagacaatattcaccgcttcccctccggcggccaatataaagacggtaccaagcagataaatactgtccacctactcatgctaggtacccgaaataccctgactacaatgcttgccgccactgccgccatcgtcatcctctctgcctatatatttcctaccatcctggcaataatattcgccgtatttgcccttgttgcaatacatatcaccacccctgagcccttctgtaccatacacatagacggggcgtctattactatcactaactgccccgatcctgcagctatattaaataaagtagctataggcccctggcgagggttaagttaccacaataacttgaaataatc

SEQ ID NO: 2093 - DNA, 537 bp, Lasius niger virus 1
  isolate Cambridge-Lni, complete genome.1
tagatgatgatcaaaaagcacttgatgattatgatgcatcaaaatctgacccatcgtttaattatggacctggtgaagaatctgctgcaatcgatactgatattcctattgaaacaggcattgccgagggagctgagatcgcttccgctggaaccccttggggtttggcagcccttataaaccaacaagtaggacaatcagttaattcagctataacaactggacaagaaaatatttcatctcaagattatatgtccaatatcaatcaacatggagtaaatgttggcttgaatgcttcccttattcaaaatcaacaacagcaaacaattaaagctggctccgctggaggaggaattggatctatattcggaccccttggcgctcttataggacatgccgttgctggaacagtacaagcgaatcctgatttattcaatactgctgcttcttcaagtggatggattaatcccactgatacaacagctgcaaattctgcttctgctgctgccccaactggtgactctacaatgcaagaca

SEQ ID NO: 2094 - DNA, 538 bp, Penicillium aurantiogriseum foetidus-like virus
  115 kDa protein1
gggattttaaccgcccgttgtattcttacacaaaagtttgttacgcatgtcttgaactgacacaatagttcccctaaaagctatcacgctcccttgtgatgtaactcttttagagtcttgcctactagttggtacaaactagttccattttaacaccaaacacatcaatggattaaacccgtgttccctccccgacagatctacaactcttagcttacagccaataaagaagcttaagtcacgttgttaactcgtcctggagctttcgtgttattgacaattccccctccccctcttttggactgattgtctaaaccccccgacttatatagacagagacgcctctatggcctctatgggtaatgtgccctgtcaacttcctgttagtcactgaagtacaatcgcattcacacacacaaactaccgcttgctcgttttacgggttgccctcattcacgggccgaatatcatgtattcgcaaagtagtgtttgctgggtcaccaaaaccggctagagtcctactactcgataaataagt

SEQ ID NO: 2095 - DNA, 538 bp, Partitiviridae sp.
  isolate H1_Bulk_30_scaffold_1057 RNA-dependent1R
catcccttttggggcaaaaggtttgacaggggattggtcaccctacaaacttctggataggaccaccctacttgcgacggtagcccgccttacccgcaagtggagagcagtgagggcggatgtttgggctagaaccccttgcgataacgagtactcgatggtacggtcacagagcaaactgtactggcaaagtcgggtcaaggagtcgctgcgacacccagacattaggttaagagtcagttctatggatgcaggggaggcattcaagctggcgcacaaacatttgcaacgcagattgcgagtaactgaagaggcggtcaaggagaagaacttacctccgctgcatcttcagcacttgcgcgctctcattgtcgcgttaaaggattggcactattctccggatagggtgtcgattcttgcgacatgtgagttggcgcgaggctcctccccccctgaaaggcctccccgcattgaacagcggtgggtgggaggggttccaaggccattcgcaataaaggaggagataccaccctcgaag

SEQ ID NO: 2096 - DNA, 538 bp, Solenopsis invicta virus 9
  isolate Formosa, complete genome.2
ggcaaacgtgtgatccctgcattaactcaacaaatatctgatgtaaataaagagtttttgtaacgctgcgtttgtaactacctgggctatttagtcttacctcccaggatgggtagtggcagccccacaatatccagggaaccatcagtatatactacatggttaagtggcctgtagtacgaataattcacttgctacaaaacaagaaaataattcaatagctcaagctgaggtagcgcctcaggaaggacagaatgctcaggagcaacaggaaataacatcatttaatgatgatcttgctgttattcctgagggagtacccggagagacaccagtcccgtcttttcggcatgatcaattcacggacttttcagaccattctattatttcgtttttagagaggtctcagcttcagtcgtcgtttcagtgggaattcgcgcaatcgggcggtgcttcggggttgaattcgattggttacgatctgttgaaaacgaacgactcgccagggttgttagtaccttcacagatattcaagccc

SEQ ID NO: 2097 - DNA, 538 bp, Wenling bighead beaked sandfish picornavirus
  strain XQTMC456881
gattgcgatcctttcactgagcactatttacagctggtttgctgggaagaaaacccgcttacgagagcgttatttcggaaccttgatgcaacaagttaaatgcaatttttattactaagttaatttggaatgttgtttatttaaacttttgttcttttagtttgttagtttatactcctatttactttagttttaacctaccattagtttattatgtttatttagttttgtttactttgaagtttcttacctggtgcattggagcgaagtagcttttgtgaaaagtccgatgttcctgaactccattgggaacctatgcggcctctgacgggtgtctttggcggaaacatggataactggtgggaatctctacacatagaggacaagcaccaacttcagacgctttgtattacaaagccgggctgtaccctgattttggtgtatggatacccatggggatggggtctgttttgtctactgcctgatagggtttttgcaaacaaatgtgtaagattataagatttgctgtagttatttt

SEQ ID NO: 2098 - DNA, 538 bp, Beihai picorna-like virus 93
  strain BHBJDX18546 hypothetical2
acctctgaactccctctgaagtttgtgctaaacaaccttgatatggtaccgctagaggttttcggacctttggcggcaatttcgctctgtgatgtcacttgacaagcaaggaatctgtcagcaacaatgacagtgtaaaattccccaagaactggcgacgatcctgaggcaaagcctataagacctcgtggtgaccctccagtgtcatgaatttcactttgcgaaaatcactgcacttactaaagaggtatgtgacatttcctctttcctttctctccttcctttcctggtacacattggttacgcaacgggcataactactcctcagacaactactgtccgtatcgctttgtgtactttggcttgctatttagcgtgcgtgtgccttgggcagccccctaaacacgtgtcagaggaccgctccagcctagttgggttactacggcagccacgcttgcgtggtggagtgtaaaactaacctgctcctacttcttcttctccttcttcctctacttctcctcctccttctactaactct

SEQ ID NO: 2099 - DNA, 538 bp, Wenzhou sobemo-like virus 3
  strain mosZJ35256 hypothetical protein1
attactcccgagaatccatggcttatccagaccatggcccggttgagcggcctgccgatgtaattcggcagcaagaaaacgctcccgcgccaccaacacccccagcaccagcaacttcggttgctccagctcaaaccacgccagcagttcctggcccttcagcccctcccactgtggccgcagatgtgacaactccctgtgtagaacagccggagggaaacgcgaacagggcctctgcaggtgtggaggcccgtggcaacgtcagccagcaaggaagtgcactgaacgtaagcgtttcagtaaaccccgtgtccaaaactcttttggaacagccggcgacagctaccaatggccagacatcgacgcctgctccgcgaagcgtagcttccgtctccacgtcgaccgatttttcgcggcgcaagcaaaccgcaaagctggtccgattggaacccggagcatcgaccgcgttgagaagagatgcagtagctggaagtgcacagtaacccgctttaaggattttgaagaaaatttcgaaatt

SEQ ID NO: 2100 - DNA, 539 bp, Ustilago maydis virus
  UmVH1 cap-pol fusion protein gene, complete1
gaaaaactatccccgctggtcggtgggccgatacccaatcggtctatggagggaattcaaatagggctctggtagtccgctcgccatcgccttcggtctttccgttatggaaggtttgcttacggtccacgtaggttctccgaccttgcgaggaaagattgcgctgctttgcagttcccttaactggggcgggttaggacgtcggtagggtgcctgtggccctgcggcaggcggatctagcacgtaacgtatcccttgccagggagagcgtgccgaattgctatgggttggtgtaggtcctcggttgtgtacggctcctcgtccacctacatcacacatgagaaactgatgacgacacaggcgtgtctaggactcatgcgtaactgctccgatgggatattaggtgtaacgactgcctgtaaagttaaagagttagcaactcgggctgaccagtctgccctttgcgtggggtgtggcatacgctaggacgtggacaaaaacaacaaactaacaacaacaacaccaagccaaaaagaaag

SEQ ID NO: 2101 - DNA, 539 bp, Picornavirales sp.
  isolate H2_Rhizo_33_scaffold_45 RNA-dependent1
ctaggaaggcctttttgtaattattcgtagttgcgattattaaatatatagctatatctcttgattgagaaatagtattctgtacttttgtatttcatttgattatgattaatttatacaaatagtagctatatacttgacaatcgtctcttgtagtttaattttaaattcctagaacaccttaacccttacaaaacacacatatcattaattttaacatttaacatatacgcgcatatcttaaaaatttaaaaataacttagtgggaactacttaaatatataaggttaatgttatatagatcgaagatttatacaaatcacgaaacctcgcaagggttgcttctattttagcattaacaaactgtattttcttaaagtaccttttgtatcaaaaacaaaaccgaccacacttaaacatgacctctgaacaataagtttcagaagcgatcggaaatgatctatcacatacgtagttgtgatagcagtttgggtgatctgacttcacccacccccccctaaaaactttttacaaatatg

SEQ ID NO: 2102 - DNA, 540 bp, Beihai picorna-like virus 105
  strain BHHK79817 hypothetical protein2
tcgcattgttgtggatatttggtgtctctatggtttgttcactactattaacgtgtcttttaggttattattttataagactagttaggaggacatacagttatgcatgcagaaaaatccaaaaacatgatagtagtgtagatgccttagagttagtgactgtatatcgatctactgttgactctcttcctatgcctgtacctttatcctgaccctcagtaccgcaagcaactcgaacaatctaaccaactgtgtggggtgcgaggttaaagtatggtaacatactctctcactatgaagccagggggagatttagtagagccaccgcccgccactagtgcggaacctgtccgtaggttgggaacctggagatcagcgtgccgaggtccataacctctcccagtgtatttctgtgtgaggcattggcaaagttatgggtagccttgctggttctgcctggggagctggaagtcttcgagcccagggggtatcgtcaccgcccaatcttgtgacgtctttttcaaacatttgtattctatc

SEQ ID NO: 2103 - DNA, 542 bp, Wenzhou picorna-like virus 2
  strain beimix73672 hypothetical2
gcatttgcatcactttgacctggcgaggtcagtaaatatacgctttttacccccggtgcagggttacattgtaccaccttatcgcagttgattacggcagagtcgaaatgatttgcttgttttattttcaattctgacgctctgcgatttgcatattattgtacataaacatgcgtctgtggagtgctgagtcgcacccatagtactattatagacttgctacaacattaaatcaaaattttacggtagaaaccgccaattcatctttgaaggaacagaatgtgtcttttaatgaccaatctgcgggctatgttcattcccttaattctgttattgattctacgagaaccaatgtggatgcatatgatgtggaattggggaattttttcgaacgtccattaaaaatagcttcgtatgagtggtcaacaaccattactttctttcaagattttaacccgtggtcattgtatttagagaatcctcgtgtagcgaatcgcatttccaattataagttgcttaaaggcaaacttcacgttaagttt

SEQ ID NO: 2104 - DNA, 544 bp, Riboviria sp.
  isolate ybw202shi01 genomic sequence.1
cttaaataagtataacgtaaaagccactacagttgatgacttgattcaggatatgactagacaagcatgtaaggcttttacgttatacttatttaagtgattgatggttgctggttgctgtgctgtaggggtcaacacctccaaagtaagatgagagaaatcaggcattctatgcccgttctcactgtatcttccttggaactgtttatcagtaactctcacacgcacaagacgcgaaaatagatctcacggaaatgaatcctttggtatatataacgaatttgctaattctactggtgttgatgatcaagttaaatcattaaactcaattatttcatcagatccatacagttttgaatctgcatttgttaaagaacaaccgtgtaaattgcgagttgtatcattgacttcaaaccagaaagattactcaaatttgttgaaaaccttaccggaagccaccttgtgtgctctattttcgcgtcttgtgcgtgtgagagttactgataaacagttccaaggaagatacagtgagaacgggcataga

SEQ ID NO: 2105 - DNA, 545 bp, Yongsan picorna-like virus 3
  strain YPLV3/16-0052/ROK/20161
tgtcaattcatttttgttgaataatcccacgtctttcggacaggtcagaccgaccttttctaatagttcaattctattaaatggaaattacaataaggctcatgattttatgaatgcgaatgccctaaacacgcttcagtatcctaatgtaccaccgcctccttatgttaaggattcaccctctctgctttcctctgcagaaaaagcaggtggattaggggagatgtcaacaatgggtataggaatgggcgtaggagcgatggactcagcactcaatgattacactaatatgaaaattgagaatcaagtgaggacgggaacagggcctgacggtcatgcgtttgatgccgtacagcatgcacaaaatcaagtggcgtcaaataatgctcattcagcattcagatcttcagcattgatgctaggatcagctctaggtccagaaggattaataggagctggagttctttcagcagcagattatgctctgcaagctgtaacacaaccctcagagaataccaccaatagcactagtggcgatttggtaa

SEQ ID NO: 2106 - DNA, 545 bp, Shahe picorna-like virus 4
  strain SHWC13603 hypothetical protein1
cgtgcatataatgtcttctacgacattatatgcacttattaggaaatctttgtacgcttaccgcctacgtgattttcgaacacgtaacgttaggatttgcttagcatttacctggagtactgtaattagttttgacactatgcatgctgtttctacccccgtcttggttactacaccaagcagccggccttttagggcggttaccgttattatacgggctcttttgagtatgaaatttttgaagatttttaatggatgaaaaatcagctggcgggcatgccccgctaggacaagacgctctagctattgagcgcctggctatgaatgccggaatgaggtacattgtttgtaccaagaggttttttagatgttgtttgttagcgataattatgctttcgaaatcagacatcctgacggtgcgaagccgtacgatacaacctcaaggggtgcgtgtcggtgtccattgtattgaacatggacatacttgtttccgggaaacaagtgtcgaggactatctcccctcgagctagcttgctagtaatgtg

SEQ ID NO: 2107 - DNA, 545 bp, Cylindrotheca closterium
  RNA virus 03, complete genome.1
aggttaaagactccctgggggtataccccagggagtctgaagatatttgagcctcgatcggctcagatttagtgtgttaaacacttttataaggttatcaatttaccaagtatgagtgttatacactctgcattggtattaattggaccttttaatcttttcaacaacctaagtatcgactgtgctaaactagcagtcaaactatatgttattataaagacccataatgtctataaacttagaattataaacaattattgtgttgggactttgttggtcccattgtaaaattatttcatttgacggaggtataataagcctaccagtgctccgtctacagctttaaactttgacgcgtattttatctaattctgcgcaagattgagtcaacgtacttttatttgtattaaatttgtaaaaatgctttgatcgaatcgatcttcgtgcagcatttgtgtaaaagcacgcgccgttaaaactctacgagtcattttggaactcttgactatatgcaaggcaagctgaggtcataaaattccaataca

SEQ ID NO: 2108 - DNA, 546 bp, Bipolaris maydis botybirnavirus 1
  strain JZ11 segment 1, complete1
gcaataaaaggcgaagccgggaggcttctattttattgcccagtttttcatctggtcaaaatgaagtcggctatctagctagcggagagtggaactggtcctcttcgtacgaaaccaaaccgagcccccacccggtgaggtaatccagtggcaatgcgtgggggagacctcggcctcggccgagtgattgtgcagaacgggtggtgatgtcagcaatgctcaccgtacatgtccgtgctagggagaatgtcctgtatccagcaggaagatatcccgcgtgtaacgactgcaagcactttgtctcctacgtagaacagtctatcacctagcggcgctgatcggccgatacagtaggtggtgtgtaggcttgccagcccaacccccgccacagacatagcttccaaacaattacacacacacaatatagcagagtgagctaatccagcagctatattaacacactacagtagatcaacttttgaatactgttatcgatcaaacacaagaatccatataccaatctcacaaattacaaaacacaaaaaa

SEQ ID NO: 2109 - DNA, 546 bp, Beihai conger picornavirus
  strain BHFishC188617 polyprotein gene,1
gggacaaccccacagctggtacaaccattgtgggttggtctccaccctttttcaaccgtggcaacttcggttaaagttgcaaatcccccctctccctattccacctcccttactttcactccccatatatggtcccagattttattctacctctttatatttttatttagtacagtggtggtgaattactcccagcataaactttgctggatcagtgttcatcaagcatactaattactaatgtactgagctatactattatctggcatctcacctggataaccggtgtgaccatatttcctaggttgcctccctatgtattttgtagcacctgtgcatctgcacgttggggcgacaaattgtaggtttcctggcacgggtaagaattgtggaaagctagtatgcagttaatgcaagggcgcgtttttcgctaccccgacactgctaaagtttttgggaggggtcccttaaacatttctagtattgagtgatagctttgcggcaggtcaccacaaccttactataaataaacctgttgaatctcac

SEQ ID NO: 2110 - DNA, 546 bp, Changjiang picorna-like virus 12
  strain CJLX29956 hypothetical1
aaggggtcttaaccccctggttcttttgataaaatagcaataatgcacaattatagttgttgcaagattgttgagaaaaacattttattcaattcagtcttaattggcggataggttggcatcccgtcatgcatttaaatgcagatatgctttccacattttaaagtgtggaaccgatactgtgctcttgaaaaatggtgtagagccgcgcttacatttgcaggtgtagcgtgaaggaacacggaccaccatccttagcgttttaacgctgaggcgaccgcggccctgaattaatcagtgtgggctagattatgccactgtacaacacatttacaaataaatacaataaaaagaaaatttgaggtccaattagaggacactaaaaaatatttgtttatttaatttaaataaaccaacccccacttaaacctttgtgggaagggaagcttctgcttgagttgagatacctttctcatttaaaaaaggcgcttttattttggacatttttgcgacacaaaaagaaatccattttatgaaaacacatca

SEQ ID NO: 2111 - DNA, 547 bp, Wenling lepidotrigla picornavirus
  strain YXMC111438 polyprotein1
ccttcgtgggcaacgatcagcacacattgtgtctgatcttggcctacggagtttacctttttgacgtttgatagtacgacaactattcattgtatttgttactttgttcaccttacctattgtttcattccctgtatatgaatatgaatttatcttaaacggttattccatttgtttcaaaggaggatggaggctatcgagcttgcatggaattgcaagcagtactttagtcaagccacttggaacgaatggtttttattgtttaatatttatttatatgttagtatacactcctagagttctacattgtttgtatgaagaatgggggaaagctacttgttagttagtaccacagtctttttaagcaattccagtagactggtatttttgaggaaaggtggtatggactgaattaatgggcgcattttttgccaacccggagagtcctaaagttatttgggggggcccttataacatttccactattgagtgatagctttgcggcaggtcacctcaaatctactataaataacctgttgattttcac

SEQ ID NO: 2112 - DNA, 548 bp, Picornavirales sp.
  isolate H2_Rhizo_Litter_8_scaffold_2011
gtttttagattttataaaaaatttcgaaacccgcgacgtttttgacgagatatgtgatttaagacacttactaaagggtttaaagttacaagatttaattttaaaaaaaaacttaaaaaacgtcgtttaaggtcacgaaaaccatctcgtttaaaaattttaaaacaatcacaaaaataaaacaaaattaataaaacaatctcaaaaacaatataaaatatcactcttgtagagtgtaaaaatgtaagtcggtactttaccgaattgtggatatcaatcttatccaaggtgtatttaaacacgtggcttttgggttttgtcgccctagttgtcgtccgtgcgttccaccttattcaaaccgagtaacaagttagttcttgtaagggctagttaatacctcctccaaaagagtttgtagtaacttgctagtacctgcttgagccgtatcgtgtaaaaggcttgtttgaatgtattcaccaatcgtaagatttatttctgattggtagataaaccccagaccgtttccaatttaatattaacccaatatg

SEQ ID NO: 2113 - DNA, 549 bp, Avian metaavulavirus 21
  isolate APMV/dove/Taiwan/AHRI33/2009,3
ggataggtgatccacctggaattaagctggttgattaagaatgtctgatacaacagagatcaaattagttaatctaaatgtgctagggagatagtgcaccaaagctataaagttgcgtattttatcgactcgcacttaattaacctgaaaccaggaatctatctttaagctatgaaattatgtgtcaaaaaaactaatatcaaattaaggagtatatccccatacacaacaagcattaataataatcatcactaagtatatagaaatcgggatcaacaatttgatcttcgtgagacttaactatacacaagattaatattaattcatgagttgactactcagtgttgattaactcttttggtcaaatttaggtgaagaatcaatataagacagtaggaactagattacaaaaaaatgggggagaacgtttgacagggcgcgtaatcagacatagcttgtctgtgtaagttttaagagatacgcggtcgctcaggagtacaagagtcaaagtagaaacagtttaaaggacaggacacggaaagcagaaca

SEQ ID NO: 2114 - DNA, 549 bp, Astroviridae sp.
  isolate ytb090ast01, complete genome.1
ttttgcattctgcaaacttcatcctcggggtcagggtttcccggcaccactcctccacccattgagtgtgtccttttggtgataacgccgccatttggttctcacactgtaggaggaggtctgtcatattgacaccgtgtgctgataggattgttcgagttttcccatagcacatgtgttgaatttcagtgtaagtaagttccctggttgatggtttaaagatgtcaaagtagcatccctcaatctgcgccgtgcagtcagtctcaagagcacgcgtttctccagctaggaacccaagcaagagaaagagaagtagcatgcaggcaaaggtccaggtccttgatgatgcgcgcacagccactgacacggcatttttgctatcgatgatggcatttctaaggagttttacctcctgctgatggtgccgtatcactctgtctttttcctgcagctctttctccctttccttcaagagctcacgcaaccgcatgttttcctctgtcttctgggatgattgtgcagcaaagagccttatcctaagctggttgg

SEQ ID NO: 2115 - DNA, 551 bp, Feline morbillivirus
  strain 761U, complete genome.2
actataacaataataaacagctactaaatagtattatgtatttaagtgtacactgataattgcgaataaaatacaccagattaataacagtatagagttaagatctaattgatatgtgggttggtactcgatcatttattagctctactgattatctatatcttgaatcaccaaatgtaagagcatcaacaggtaataagttttggattgctagattgacacttaattctcagaactagaatacccagattgtcaaacctataaccttgttagattcattaaagttagattcttgtaatgttgatcaattatcacttgagcaattataaaaaactaaggacctaatgtaataggaacccaaactccatccagtgagctctaaatcgccatgcttgaatattaatttatctagggcctgtctaactcagaacaaagatcacaactagagtctaaaggagtgggtcaagtctgaacaattatcaagagccgagattcaaaactgattcctccttaaactcagaaccctaacaatatatcatccactcaacatc

SEQ ID NO: 2116 - DNA, 551 bp, Eel picornavirus
  Eel/31945 RNA, complete genome.1
cccctggggactggcgcttacgcgttagtttccaggatggtcttttcaacccagctatgggttaaatagcaacttttttatttttccagtttcactggactgtgtattggacactacacagtataataaaaggtgagtctttctcaccactttcgtgtctagcggttcaactcatttaggcatgtttgtcaatgtatcaatattagttgaagtgaagatttggaatcacaccacaaccccagtggtgcccaccataactctgcctcggatttcctccatagtaatatggaccttggtagttacacggtgttgtttatacatgagtcttcatggatcttttattgccgattgccgaacccctctatgaccactgttccgttaaggttttgtaagtctgctcccatgtaaaagccttggtcgtgcttaaatgccttcccgggtgagaggaaaggcctacttagctcacgcggtaggaacacctgtcatgctccgacacagggacttatattgccgaaacccattttccattttaaaccaactactctctcact

SEQ ID NO: 2117 - DNA, 551 bp, Beihai levi-like virus 29
  strain BHZY57867 hypothetical protein1
ccctgaccgggggcaagaacgcaagttcacctctggaaacacccttacaaaggggtcgtcagtgtttggcgctcttctgtgcggccaggggtccaattaacagctatttactgttagacacatttcagtgtcggcatgtggatggcattcgcgatcgcacttagcctaaggaggttacacctgtgcgtatttcacacaagtataatcaacctctttggttggagtgtcggtccgataaaaacggcccgctcgagtacgctcagttacctattattggcgacggcgcagtacctgatagacttctgccgtacaaggttgcgaaaccttatactcgtgcagatgtccgtctggatcacttagttcccgcacctattcccgctggagttagcttaattgagcttcctacagcagaacaggttgtaagttctttgttatcgagtcggcccacgttggcatcgtcagtatttcaacctttcgttgatacagctggaatccagaactcagcattacaaaatgctattgagtatggaaatatcttgttactcgtctct

SEQ ID NO: 2118 - DNA, 553 bp, Wuhan arthropod virus 2
  strain WHSF0 hypothetical protein 1 and1
tacggttttaaaaccgtacgcaatatttgccatctagctcctgatgtaaaattgagcattaatcaagtttagctctctactataaattgagtaattgttcgtgatgaaatattcatgggcgactctagctctctagtataaattgagcaatcttttatttagtgcttattgttttattgaagacgactgatggcatacggaattgtacttttaattaagggttagtatcctaatagtaaccatgataccgaataaagtaggtccaaagcaaagtgaaatttgtggaggccgtcatggcaatgctattagaactgaggatttaatgcttgacaagcgcaatatctgagcagatagtgtaaaaaatagcaacaatagttaaattattttacgatatgttatgaatatgttagacatgtattatgattcataacctctattcttaatttaactatatccaagtctcggtggatattggattctgttcgcagttaaccgtatttttacattgcccgagtcggagcggtgatattgtatccggactacttaatacaaa

SEQ ID NO: 2119 - DNA, 555 bp, Miniopterus picornavirus 1
  strain Henan-Ms56-1 polyprotein gene,1
cgccttttaggctgtttttccacggctgaaggtgaaagaagtcgttacccgcctgcctacttcgggccgggctagtaacatggatactaccctaagtgtgtgatccgggtgaggttccccccctccccagaaacttgtgatgagggtcaccatcccgcatacggcgacgtatgggtgtccctgcgctggcacaaggcctgctcctgaaagggacaggcgcgcttaggatgttgaagtgtgaagacccggactgagctaggtatggagtcctccgccccctgaatgcggctaaccctaaccccggatctgtcgcaggcaatccagcctgaaggcagtcgtaacgcgtaagtctgggatgggaccgactactttggggtagcgtgtttcctttttattttattatggcgtgtatggtgacaacaatagggcattgttgttatcatacgttcagcgccttcctagctcttctacagtggttgataaccgctgtttcactgatccccagtggaatttcttggatttttctcggcttatttttaggaggatttgcttaca

SEQ ID NO: 2120 - DNA, 556 bp, Shahe narna-like virus 3
  strain SHWC01c3372 RNA-dependent RNA1
gtcagcaattccctctaatagggccgaaaccttattagactacttagtggaacagtacaactcttgcaagttgctgtaaagctgagttctcctgattttcaatcaacagaaaagagcctcattggaacgacatacaaagcgtaatcgttcgaatcaatgtcctattttcgacaggagacgtgtaagtgataacacgtgccagtcacgaccatccggtaacgacagagagctattacaaacgaaatgtattacaaatagtataattaaatctattgatacattcttagcactccatcatcttcacatagatgacgtaaattttaattcatactctaaaaaaattaacgagtatgttgatgataacggtataaaaccgttaatagacagttttaaatatttctgtttttacaggttcaataagtttattggggatcttgatacataccccaagcctgataattatttagacctccaccctaataggcatttggagaaatatctaaacagaaaactgtcaagtaaaacacctaggaactataaatttttagtgtcatta

SEQ ID NO: 2121 - DNA, 557 bp, Tacheng Tick Virus 4
  strain TCRP-1, complete genome.1
gtaaccaacatcatgagaggcaccccacctacccatgcggcatcattctctcattggcaccctaatctgctcgcttagcattttgtgtacctcgccattctaaaccatactcattggggcttcattggtttaaaaccatgccgacacaaaaattccatttttgaggtctggactctctcccctcctcaccccaagagactatctgactaccgcatcatgtccagccgtctccccccgggtcggtatcgtcggcagacgccaggggttggccgcggtagacgcccggatgcttcgtcggatagcacggagtttttaggggccgggggtgacatagagcaactacgcattgcggtacaaagcctgtcggaacaattgcagagtatagaagcccgcctcgtcacggtggagaccaaactggtgcatctttacgacgttgccgtgttcccacagcggcgcaccaggccggatgtggggaatcagttaccaatgggcatgtagccgacacaaaaaacctccaattggtttaaaacatcaggatctgtcctgatgtttagacc

SEQ ID NO: 2122 - DNA, 557 bp, Hepacivirus J
  isolate Hepacivirus/RMU10-3382/GER/2010 polyprotein1
gccgctcccgaaagggagtccggcgcgtcatcccactccgaggagtggggtggcgtccccgtgtgccggggaaccatgaagcctaagggcatccacattttagaatgaacttgaagcttcgtttcgctggccggaaagtcctgggttcccatggccagggttccgcaggtgggtaaatcccggtggggttccatccaggatatacggcaggcgggcgtagtccggcggttcggacgacgtgtgggtcgcctacggtggattgttcacaggatgggcactccggtgtgaataggccccgtcagggtgcgctgacgttaaactcaggccttgcctggtgttcggggaggattgcagggccacgccgcctctaagggccgtatggcacagtacttcttcgggcgggttgtcaaggccctccaacgcgacaccagtgcctcggcaggcatggggccacccagctcggcgtcccgcacacagacggcgtaggggaaaatcagcaatgtgaccccgggtggcattttccttctctctacttccatgcatgatcaaccgcaatc

SEQ ID NO: 2123 - DNA, 558 bp, Beihai picorna-like virus 55
  strain BHBei68636 hypothetical protein1
tgggtgatgagcccggtgaagatattatattgctttttagttttattaggtagttcagttagtttttctaactgttcttaacttttactctaataagtagtatctatcttcattagcaattcatgaagtgatgtttaactcctaccacctttggtgttagagggggattcttactatcctctttaattagtaagtttgtttgggttcaagccccaactgtgaaattagcttgtagtacaatatattgaggcgtgtgactgaagaatcacacaactcgggaagtgaatacttccctctgataggagtagcagcctaccagagtattgcttatatagtttgcacgacttgaaatttccttttcctgatcgttcccgaaacgattcattaactatgagggacgtggtcctagagggactaccgtatggtaagacgatagaacgttaatctaaaaccttcccacgttaagaccaatgaggtattgttcctataccgtgacattgagtctttgacgtgtaataaaagtagttattttctaaagaggaaccgtggagacacatt

SEQ ID NO: 2124 - DNA, 559 bp, Plasmopara viticola lesion associated narnavirus 39
  isolate1
gcctcaaaagacgaaatcgcacgacaaccctagggttgacgtgtggtggaacgcttgcgaggcggtacacgggagtcggggtgccatccgtcctaagggacgtggggccacccgacaggtactccctcgcaacacgcggcagcgtgttgcgttcctaaagttatcccccccctctgctgcccacgccaagttgttaaacttggtgtgggaggccctcctcggtgtcgcggccgcctaccgccctttgcctacctgggggagtcgtttcggtaacaagcgttgcttggaacttcaacggctcgccctgtggttagtaagggcggcagacggtcaagggatcggagcgacgatcgcgtggctaaaaggcgcggccagtggcgcccgcaacacttgtgttacaggcgcggccttgctgccttccacgcgatttctcgtcaggaagttgctgatcggcgatactcgcaatgagtcgctggaccagctgtccttcctttcccgatcccttccggaaggggactctgttgttgagtccaggacacttgtcgctcaccgcgacaat

SEQ ID NO: 2125 - DNA, 559 bp, Totiviridae sp.
  isolate ltt164upi1 genomic sequence.1
tattcatcaaatatatcaatcgaatccaatactttatgttcggttacaggcggtgaaacttgtaaaccttgataaaatacagaaccagattgtatattacaccacttccgttttggtggtaaaggaggtggagttggaatatacatcttaccaagattatgtttagacattttagctggttgggcagaaatgaatgtatatgtcggagcatagcagcggaccactatacacaaacatcgtatattgaggtttttctctagtttatcgttgatatgagagctcttgcgtcatacgtggcgtctgggtagctcgtactcatgttaaattaggaatcgttcaccaaaaccaaccctctttttaaacccttggaaattttatctgattctaagtaaggaacttagttaccaatgatcttagctgataataaattttccacaagcatttagtttagtgcaatcgcttatctgggatagcaacccgttagcactcaacttccaattctcctatttctggtttaaagccagcatgatccctaagcgggagatgattgtagaaatag

SEQ ID NO: 2126 - DNA, 562 bp, Sclerotinia sclerotiorum umbra-like virus 3
  isolate BCS17_DN251
ggggaatctggctcgccaccagcctcaagctcttcccacaaacttaaataaaatttaaatttaaactaggcttaaactgaaacttaaacttagacttacacttaaatttaaattttcacggtgagactcacactacctcacgtaaaacaaagttgtggcgatgtgcgtgtacagtgcacgcctagttaaatcactgggggacgtacgagctgcttgtagacacccggcagcgaaataagggtgtagcgcagctggcgcaacgatttgttaaggatctgacactggaaagacagactctcatctaattcttatccgtatgctgtgctcaccctggcgggggtttgacgcgtttgcttagagcaacatgtggacgggttttcgtggacccaggcgccgtgggcgcaagcaaggtaagcttctgccttaagagggcccccccgcccggggggtgatttagtacacacggtgtgtcttcacaaccgcggcgtgtggcacgtccagttttcaggccagggtacttttccttgatagatggaaaaaccctccactcccagcacacacg

SEQ ID NO: 2127 - DNA, 562 bp, Yancheng osbecks grenadier anchovy picornavirus
  strain XFXMC154601
ccttagggtctggaatgcgtcctttctgggcacttccacaatcctaaggtaattttcaacgccagcgatggagcgatatccaaagaacctttatgttttagttcgtcttgtatgtttataaaatataaaattgggattagcaacccacaaaaacatttttgttattctcaccacatgagagggtggttaaacctcttcgtaacctatcttgcttgattggctacttgggctagatttaggacaacctctttagcaagcctaaattactcctcgtacttgcacctggtaacaggcgtacctggaggttacggtggcgctaacttggacttctcgttaattcgtgcaagtttaaatgatgcctattttgaatacaagaaagtatgatagtaacttagggcgtgaagttccgcttaacataaggcagtataagtactaagataaggtgtaagacctaccttaataactgttgtcttttctcatggtctttccgtgggagcccttgctaggggtaaagttaagtattctcaaataatttttcattcaaactctttctctctgtttt

SEQ ID NO: 2128 - DNA, 562 bp, Beihai weivirus-like virus 17
  strain BHZC37426 RNA-dependent RNA1
cgcgtaataccttgtttcacccccggccgctgccgggattttaataagcgtgtttaagcacctacgtcccaccttcgggtgtaaattacctgcgatctgcgacacaggggcgcagggtcgtgcactagtcgatcggtttgggcgggccggtcgtcgacgacggagtgctgccggtgcacgataagatggtccaggttgcaatgatccacgcgcctggtaggggacgcgggggggggttttctttatatcgactccacacgacccccccttggccgggactgtccctaactccacccttatgcctgagtagccggggctagtccggtgaacagcctgggaacgctgggaagcgatacggtgagggcgctaccgctacccgtctgcagcggtttctgttgtgtgggcgacagagtaaagtggtagtttgcgcatgtgagggtcccgaagcggagcggcctgcgagtgcagggtttagccttacctgcatgaatgtgggcttagctccgtggatgttccgtttggctcgcacggccaggtggataatagaccgcaaggtcttggc

SEQ ID NO: 2129 - DNA, 563 bp, Picornavirales sp.
  isolate dwb062shi1 genomic sequence.1
tggcgagcaattgattaactcgcccgcactatcacgcggattgtaagttcaaacggattgactattatgcggacctctagttcaaactttttgaagcggactattggttcaaacagatattatttcacgcggatttacagttcaaacggataagtgtgcttagatcaccttgacagctggaaagacagcaaacaacaacctttacattacttgatgcttattcagtaatggcgatgagaaatctcgtaatgactttatagagtaaagggcggaaacgtgttttactactaggagaatacatgcgagtaggttacattaggagttgattgataacgagtcctttgatggcactagtttatttcgtgcaaacccttaggataacacatggtaacatgtgcctttgggcagagctgattagactggtgaataccacaaagtgaattgtgcgtcgagccttttattgtaatatcggttactagcgttaacgaatgctagagtttgttgtataacactgcattgcggctaaagtaagtgtgagtgtttgactttagagtagtttcaag

SEQ ID NO: 2130 - DNA, 563 bp, Wenling jack mackerels picornavirus
  strain LXMC375591 polyprotein1
gcacggggtttatagccccgtgcattgatttcgacggcaagttattgtcgatagagtattacatacgttggatattaccattccttctaaggaggtctggtgttgtctttcatatgttttatgtcaaatagcaaaattttccaattaccttttacccacattttatgtttgtcttttacggttctctccgtaacacataattgtctaagtgtgtgtaaaccttttatcaggaaatagagaacttttgattgcctactttatattaatatttagcgaaatatttgcagttaggaatagttcgtcaattagtactgctccccgtaaggtgaactttttggcatgcaagtgtgagcagcaccttgtccttaactgtatttatagtagttatctaaattgatgtttggtaaggttgtcttaaggagatctgattataaggcgattggttgacgttacaactaacccccctttttctcatagcacaatttacaggagtatcacgtgcgctaccttttacctattgttcgttgtttttcatattgccgcgaggtgcaagacttcctaat

SEQ ID NO: 2131 - DNA, 563 bp, Beihai picorna-like virus 24
  strain BHZY60459 hypothetical protein2
tttcttctttttggactggaagaaattttgtgtacatatttataagtcctttttgactgccgatgtctataaaagcctggcgctagctgcatctagttgttacctaagtaggaatgtgcctttatatattagtgatttagtgaatttcatatatatttatcgttttgcatatgttttcataccctgtatatatttgtatttataaaaccttactctcattgcgtcattgcttcacgcgcaatttggagtctaaacatagctgataagcaggtaaaacattttcaattattacggacagattattgccatgtcttaaacaggcaattagtgggggagagcctcgaaccacccacattgagaggacacctaccgttcatgttcatcagacaagggacggttccttggaacttgatatagggagacatcctattgatttttccaaatcagacatagacgctatttcgcaaacaggaccagtagatagattggtaggattgaccgggaagtacacaccaacctgggcagtgcaaaaacctcctgatgttgtagttgatgtcagttac

SEQ ID NO: 2132 - DNA, 565 bp, Rudphi virus 5
  replicative protein and structural protein genes,1
actgcgtacgggaattccccgtacgcagtgtttgcaagtagtttggcatcaaatatgcccttatgtagcagagaaccttctctcacgaactacgtgttcgtgttatttagctcactccctatgtttgtctatcttcaaaaccatattctaagtatgtgaattactaactcacaccccctttatgtatttttaatggaaaagcaaaacgacggttatctagcatgttgctagacactccgtggcctattgtctctcgagactctaggcaacaacagctatgaggtcgccccctcttagctaaccttatttttattaggatggtaagtcctttgtttatgtaccttttaaacatcaatttaccgattactgattcgtccttgacgatcactctcacgagtgtcagaattatacattcagaactaagctctaatcaagagcaaaattcaactatacaggcttttagttgtcttattttataagcgatcagtgaaatatcttttcaggttttagtatggcctttagttaatacgtttcacacgttaagaactataaaacattaccaacc

SEQ ID NO: 2133 - DNA, 565 bp, Plasmopara viticola
  lesion associated mycoophiovirus 5,isolate1R
caaaaaacttgactaaatatcgctaatcctaaaaatgactcgagtgattgaatttactattgagtttcatgaggatgacattggagatatcagactactctcttactactttccagatgaaactgactctccaatcacactgactccagagatgattataaaatcagttgaagacaaataccctaacatttgcatcgaacaaacactgagatatgaactaatgcagtcaggtgatctcgtagatgcgagagcagacgatgaatttgaattccacgaagatcatgtgatctttaaaggtgaggaattcagttctattatgttgtatctatatgtctctattgatgaagaacaggaatatgttgactatgaaagacgcttgaataccatttgaatccttattgacaactttatgttttatttttatttatgttctagcagtatgagcatcatttgaaaaaatttgattaaacattttgattaaaaaaacctatttgatctaagaaataaagatttaagtttcccaaactttgaacacaaagcattttacaaccccaattcttcaatc

SEQ ID NO: 2134 - DNA, 566 bp, Beihai picorna-like virus 20
  strain BHJJX25607 hypothetical protein2
tcctcataaaactagaaacccagttatgattctgggtgctacggcgtagcaaaaatcatgtgtatatatggataccaagtattatatgtttttgtatgtttgtgcttattgtgcttaggctttatacatatcggcattccacaaaaggaatacacctttttaggtgaggtttcgccagccaatgtaaaatataccactcatggcactgagcaatgctttgagattgtaaaatatcgcttactattaataatttgtataataaaaatgtgagagtaaatggatgtgaaattacctatgagcagccaaccattctcgagattttatcagatcttaaaaagtttggaataaatcccaaccgatttgataagttgtggcgtaaaaaccgcaaacatttaggtaaacgggtcgaatcttttgatggtgtaaccattccttcacaaaggattgtttatactaccgatatttctaccttagagccgcatagtgggactgaagcaacagtttcaacagcggacgctgaaacaaagactgccaacttgcaattcgttgatgatgttagtccacat

SEQ ID NO: 2135 - DNA, 567 bp, Plasmopara viticola
  lesion associated ambiguivirus 1,isolate1
gtttgggttcgtcagttggaggctgttttgggctcggcccctggcatagtcggggctttcgttaaagggcggtggacaccagacctcccctctagcgatcgctccgtcggtgctaaccttgccctcagccatccgacaggtggtgcaaagatccttggtgggggatctgtccgtggcggcactgcaggacaaccgcgtagggaaacctacattgttgtggagctatctgatggctccagggaaactgttttccctgaactgctgggtcgtttggcatcttattctcttctcagagagagaaacgccgatcttgtttctgcccttcgccttcgggcgcaggagtggtgcaagaatgctgggctttcgagcacagtgtcttggtgggctgtttgttcagccatcaagttggcgtggcccgtgtcggagttggaaacctcggtttccgacgtcgtaggggtcgggatgtcaaccacttcttttcctggtctggcttaggccagatcctttgaccttaaggggctttgctttggtgaatgtcccggccctcttcttgagggttccaccctg

SEQ ID NO: 2136 - DNA, 571 bp, Picornavirales Q_sR_OV_022
  putative polyprotein (Q_sR_OV_022_gene1)1
gcgaggataccctcaccggtatcttcgcagactctaaacaatctatacagcgtgtgtatacacgtttgtttgatatgattgttcatttgatttaataatgttttattgcctcagagtgaaatctgaggtttggaagcttacatgcttttaaaatattcattgccaccatggtttacgcaccataggtggtttgtttcattgaatagttgttgatttctcgtataaaaacacacaccctccaaagttggaggtctggtttctaagtgcataagcttggaagttaattgtgtggattgtggccgagaagctgctattgatcttgtttaagatggctcgatcgtaattgtaaaatcatctctctatgtaaatagtgaaaattgccaaaacgcacgtaaaacacattgtcgtgttagtcgtggtctacagagtattgtaggaaagataggtttgctcagcctttaaatgagatgatggtgtaaacaccccctgtctgacacagaggaagaaatgtcaaccgtttagtgtagttcgagcacttattatcgaatcggtaggtccaccgtaaggacat

SEQ ID NO: 2137 - DNA, 571 bp, Clownfish picornavirus
  isolate CFPV-2015, complete genome.1
tagtgacccaggggggggacttgcgagtccacctctgaggaatctatttaacgccctggactagcgtatagtccatgctgtcgttttgcacaaaaacgtttaaatgtttgtttgttattacatttgcacacatgtaactccaacacaccctatcctaagtacattacctcgtggtattatgatactggcagaaacagaagttgttggagtgaccttttagacaacagtttagaaagtggcgggagtatcgaacccaagcgctagattgttgtatattagctcaattcattcaattatgtgactgtacatgacaaataccattagaaatcttatcaccaccactggttagcaacccagatgtctttggcattgcacggtctgctataaggtggaaccatggggtaagcttcgcaagactaagatactaagtccaagagtaagggttaagaatttcttccctgtggcagtaccactcaaggatgaatggtcataaggaggggtcctatgactgaggtattataggtgatgaaccagcgcgcatggctgtcttctagcgaagtaaaataaatat

SEQ ID NO: 2138 - DNA, 572 bp, Hubei odonate virus 2
  strain QTM74832 hypothetical protein gene,1
gtgcgcagggtttttatccctgcgcacagctttactgatcatggtgattttcttgaggcatatatcggcacctatgtagtcactgaacttttgtgttaagagagtggctttatcacaatgagtttatctgcatatttgtcgttattatgtcttccttttgcaccaagatcatttctagtgtgaatgaattatgtatgaatgtgaacaaaaatatagataacctaccggttctttcaatttcgtattctttatacattacatacttgtacctttgctactattttgagccttcggaaagctctttgagtgggtagtagtatatgttaccttaatgctaatatgtacgggacgatgtatgtccttacagtgcttgattagatgatagtgatgatagatatcactgcgtgattcgttggtagagcaatactgtattgcatatgatcccctaggcggatgagcattatgtcgtagtatgatagatctttattttcttttgaagttttatacgtttaagggttttacgttaaaacctcagagttcattgcttatattttatattgttcattataaac

SEQ ID NO: 2139 - DNA, 573 bp, Hubei picorna-like virus 78
  strain WHSF6879 hypothetical protein 11
ctgtaaggttactcccttacaggttctttgataatatattacagctgatttgatatcttacttgtgaacattcagatctgttttaaaacacttttctgaaatgcttagcttgtattttattattttcagtgtaactatcatctttatctggtgatgttgctctcaaattttgttaaatttgttagttcagcatgctttttatcgtatggtttttacagtaatatatttgatgagaaaccttttggaaaaaacgtttactttaatgtaaacagtttaattcatattcatttattaatattttcattttcttgtactttgtacattcattttcatattgtcccttggatttaaaggacttcttaattgagaaacagctctctgcggagagtgtaaataacttatctggggtagtaacccgttaacagtttcaatacattttgaatatccttaaagtcttcccttcccgtatttaagctataagactcggcgagttccgacgatggcaattttgttttatcttttcttacggagtatgattatttgctttttaatgatagtagtaacttcggttca

SEQ ID NO: 2140 - DNA, 573 bp, Cucumber mosaic virus RNA3
  strain fly60335 protein 3 and coat1
gtgtgtgtgtgtgtgtgcgtgtgttagtcagagttctttgggggccacaagttctcggtcacgacagccgaccggccttctattggcaggccggcggtcagggacgtagcatatcaggggcatcatctcccgctcgctcgccccagaggtcaacccgcctgacggcggaatcggctcaacggggcgatcgggacgattagggtaggtagctctgcttccgctggactcgcgtgccgcagaaggcgaagagggggcaaacaacgacctatgcaccgaccatatccgaccaattcacatcccgggtacgcgactccgggaactcggtccacaaaatagaatttcacgctcgtccctagcgactttctgaaaaccgaaagtcttccgctgggatcgtgcgggggcgtgtaagtggggcggtgcgtgttcttaagttggtgttaacagctgcgccgcgactatatgtaggtgtgtgtgcgtgtgtgtgtgtgtcgcgtcgtgtcgagtcgtgttgtccgcacatttgagtcgtgctgtccgcaccttttcttttcagtgtgttagaatacccgaggc

SEQ ID NO: 2141 - DNA, 574 bp, Wenzhou picorna-like virus 7
  strain shrimp14504 hypothetical1
gattaagttactttaaatggatttatcaaccattgtatttttagtatctttcctccttgttgggaggtaaaatttgtggacttgatttagttagtatttagaaagttttcgtccaacttttgtttgatatactgtgccgtcatattcttggcacaattaagggttgacaccccggtaattgctcatgaattgataattctgagcaactttgtttgatctcttatgtaagagttatttactccatagaagagtttcatgttggtgatacgtatgattgtggacccgtctcgtagggttattttaaacacatgattttaacccagtttgttccggctgggagtacaaaacaagacttctgagggtggcaccgatgaagagtcttgagccataattgaaataaatctatgtgaggctttgtttggattgtttagtaatctgtacgcgacgtttaaggtattcaaaaaccttggcttcggccgtaagacgtgcatgatcgctttacatgaatttcattgttaatttcgcattagagtgatgctttgttgttgagcacgcacttttattctttatcgct

SEQ ID NO: 2142 - DNA, 575 bp, Ginkgo biloba picorna-like virus
  strain pt112-upi-3 genomic1
cccagcctgggcacctttttaggtttatggttagcgtttccctttaacgcgaattctagtataaggttcgctggctttgccgcaccttatattctctctttcctcttattatcccatctagttttcaatcttttcttcaactagtcactctttctaatttttcccttctattttgggggcagagtaagtctgttacctgagtggatagaggtacacctctcgagtccaaaccttttctttttgatagtttgatcgcttcggtgggcacatagtgatgagaagtaagcggtcacaggaggatacaagtctagtttccatggtagttgagaagttttgagatcgttgtgatacgtgccctacagctgggtaggatgtccgagtggacaccatctcgtggtgacttcaatacattgcttctggaggacttggcttatggtgttggctaacaccggaaaatagcatatttgttgggtagaaacttgactagtgttagggtggtggtaacgaacaaaccctttgccagtactatatgtccgtgcataaataccgatttttgcccccaaaaccgctttttc

SEQ ID NO: 2143 - DNA, 575 bp, Diaporthe ambigua RNA virus 1
  complete genome.1
gggaaatttgtgagattatcgccctaaaggataactctcatgcgggtccgagtcccgcctgggaacgatatgtcacgtcaaatggtggtagggaaaccgttgaaccaccagaccaccctggtccggcttgtaggctgcgtgggctgacggaacagcagttggcgaggagctgcgctatgtaataacgggtggcccgttcctagtcatcgtcgaggggcaaataatcgctcccacttcggtgtcctcgatgtgaaaacaaactcggttttctcgcgggttggttacctgctccagtgagtcgattaaatggggattagtgctgtagggccccagccacaggttcggcactggtgtaacaaccgtcacccaggccagggtgtatgttttggccaaagacacctctagttccctgccattccggggaaggcggttttccgctaggtggagaaccaggctattctgtttgcagattggtgcgtgttagcctggactgtgggtgtcagtcaactcacctgtgagagatggtcatagatgcctcagtttaatcttagccttgaccgggtcagcgctccctt

SEQ ID NO: 2144 - DNA, 578 bp, Agaricus bisporus virus 9
  isolate AbV9-003, partial sequence.1
tatcttcctcccccccgcccggcatggcttaaaagttccagaatgcaacaatgaaggttacgttatgagtaaacggtcttggtggtccactttactgtgggtcaccctgcactgtctctaagcttgcactgctgtgccaatcatgagcgtttgttagttaagctgcatccacttcactgtggatgaagaagtcgttctccgtcttcactttcagcatatcggagcctcagtgcgttctgacattaatttgttggacccctgttgagtgatatggaatgacccggcagtaatgtcgttaggtagggccccggtgcgcttcgctgcgtgcacccctactgtatgcaacctgtgatccattacaccattggcccattaggctaggttgctgtccgagccgatcgtcctaattagacgagcatcgtgagcacataactcactacgtcgctgtgttacgttggtccccaccctccgtagactcacccacagcccgtgaaggaatacaaggtgtccttctgtgtagagactgcacgctcggcggtctagttgccacactaggctgaaaggaacagtccacccac

SEQ ID NO: 2145 - DNA, 578 bp, Trichosanthes kirilowii picorna-like virus
  strain pt111-pil-1-NW1
ataactccttaaagagaacaatacttataggcaataacaacaatgcaacaatggaagttaacacaggaggattagaggttattacagtctctaactcaaatataacgatcatacctaaagaattttcattaacatttacatcttacaatgcccagcaaacgttgtcactattcccatttcaaccattaccactaaataatttacccgaatatttaacttttgacagaaaatataaaactaccactccttttactttaacgtttccaactgaaatgtctcaggttgtgatggatatatttgggttagttataccagcaaattcccttagtggattaacaattaattatgtcattcaagattcagatgcttttgtgtttcaaccccagatttacccgaatcttatagttaaatctaagtcaaattcagtgaaccgctcagacgttatttctccaagcactcgtctggtttatcccaatggtttcaatggggatataattttatccttcgaaaccttgcgaggcacgccacttttatctgattctcccttggtatttattgttagtttgagttaaggaggc

SEQ ID NO: 2146 - DNA, 578 bp, Beihai paphia shell virus 2
  strain BWBFG38484 hypothetical protein1
cctcgtacggacgttaaccgtccgtacgagatatagtctagttggcagcttaaacccgctgcccaggttctacctgtattttaggtactgttctggtttgctctggaatgggatcgcatcgtacatggaagaaccatgacgatgtcccactgtagagtgtaccacactgttactgctacgattgacagctatataaaagtttttaatggagggggagttaacctctgtaaaaaatcataaacccttataaagtgtttttcatactgattcaaaggcttgcacttgataaagcctcaagatctaaccccataatcaatgggattactgtgcatacggaagtaccggagccagttcttatgatggtattcgcttatatgccgaaaataaagcccccgtcctaacaaaacaaggtgggcaccctacacgggtggacaccgagccgtagagtcacgggaagtgtagatttgaaagagcttgctcttagtctgcttctatacgcttgacagagatttgagttttgcacttgtgtatatagcgtctcatttgtcttgttaaaacgtgtctcgatttgttgtcga

SEQ ID NO: 2147 - DNA, 579 bp, Shahe picorna-like virus 8
  strain SHWC12398 hypothetical protein 12
actcacccttttacaataaaatttctactagtaaaagtaaaaggatgcttaaccgttaaatgctatcacactaaccgcgtgctctatttagagttatatcctaggatgcgcgaagagcaaacctcttaatatccaaggaactagtagtcgagtaaatgcactaagttatgctttactttaaataaataacttgcgaatcaacaaaataataataatgaaataaataatgtagcaccccctagttttaatgacgcaccagatgcatctttgcttcctaccgaacagatatcttcacttgtaacgcacgatgatggaggaactcctcatgaatattattcttctaaacctattcacgaactatcacaaattgaacaagcgactggtaacgagtttactaaatctttggataatttcctttctacacccattagggtagcagctggtacttggactactacacagacggcaaatactgacctgcaaaccttaaattttccggatgtcttgcttaacaaaacattgattgcaaacaaattagatggttttgctttcttgcatgctcgtgttaagtttcaggtg

SEQ ID NO: 2148 - DNA, 580 bp, Unknown
  Description of Unknown: Mutant Zaire ebolavirus isolate Ebola5 sequence
ttgcaataattgactcagatccagttttatagaatcttctcagggatagtgataacatctatttagtaatccgtccattagaggagacacttttaattgatcaatatactaaaggtgctttacaccattgtcttttttctctcctaaatgtagaacttaacaaaagactcataatatacttgtttttaaaggattgattgatgaaagatcataactaataacattacaaataatcctactataatcaatacggtgattcaaatgttaatctttctcattgcacatactttttgcccttatcctcaaattgcctgcatgcttacatctgaggatagccagtgtgacttggattggaaatgtggagaaaaaatcgggacccatttctaggttgttcacaatccaagtacagacattgcccttctaattaagaaaaaatcggcgatgaagattaagccgacagtgagcgtaatcttcatctctcttagattatttgttttccagagtaggggtcgtcaggtccttttcaatcgtgtaaccaaaataaactccactagaaggatattgtggggctagcaacaca

SEQ ID NO: 2149 - DNA, 582 bp, Lothians earthworm picorna-like virus 1
  isolate Q48, partial1
gcatgatacattttaaaattcccattttgggacgttgattattgcgtgatataatcattttcctttggacgttgactgttgcgtgattcagtcgtctttttcctcttgtgttattttctctatttaataaatccaaaaacaaatagagtttagtttccattttatattatttcgggcatcgttttggtcaagcgatgtagatcatatgtatgatcatttgttagcttatgtttaggaaagcattacgaatattcttaagatacaggagttttgcttgcggcgtggtacccgtaagacctcacaccagaaaattagttattttaatttgttgtctcactgccttgacccgttgcgattagaaagtaccaggattggtgccatgtgcttccgttatatcctgcgaaatcgataatgtcgactgcggctggatgggctttgtttcagggcaacattgagaaataccaaaaatatgtttatgtgtgagtggctcccgaggtcggggatattcactgtgatgggcttctgaacataagagtactaacatgtgtgagtacttgtgatgtgaccacctttttaaacatt

SEQ ID NO: 2150 - DNA, 583 bp, Populus tomentosa Cucumovirus
  segment RNA3,isolate pt120-lat-16,1
tttggtgtctttccaaccgacgtatgattgtcctatggaaagacaccaaagcgggaagatcatggttatgtaacgaaacgcattgcccatctataggagacaactccttgtcgcctagatcagctaagtaaattctcaaagacccttcagcatcagtggaaactgttcgagtaacagcacataatacctgggggacgctcatatatccttttgagcacaattcaccaacatcatatccagacttaaagaaggaagcaatacgaccgtgggtcatctcgggaacgaggggccggactgaaatagcattatcagcacgcatccaatgatgccggcctaggtcacactcagtagccattttcttaatggcttcagggctaaataatatcttttgaagatcgtcagacgtagccgctgaggactgttgagttaaagtcctactggtaccttggaaagccatgcctcggtaatcttaccactgtgtgtgtgcgtgtgtgtgtgtcgagtcgtgttgtccgcacatttgagtcgtgctgtccgcacatatattttatctttctttttcagtgtgttagattcccgaggc

SEQ ID NO: 2151 - DNA, 583 bp, Beihai paphia shell virus 3
  strain BWBFG40853 hypothetical protein1
tttatagatatttatatctatatctttttcacgttggaaggttttaacattctttgaatggtttttctttcaacacccatctatcattcattttattaactcattattcttttaatcatttcttcgttttttcagatttactcttgtcttcggagtaatgactatcaacctcttataatgagtgtttatattatttgatgaatttattgaatcactacattaatttgtggtagttggtgaccctgggtttgaacgtaccctcggaaaaatcctgtttcaatatttacatcatttaatatgaatgttctcgagctgaactcaatgtagctcatcctaaataaatctttgagagtttgcgcgactaaagtgccaagatgtggaattcatccatgagtaaacatgtaaaaacgtgcgccacttaataatatcttccgtgatccaatggtggtggggtgtcccgactcgaagaggtgaccgcgcacttgagaccgttgcgacatacgatctcccctgttgctttgggttaaaagcatgtccttctctccaattacgttttatggttacaacttttgctatatagata

SEQ ID NO: 2152 - DNA, 585 bp, Hydrocotyle vulgaris tombusvirus
  strain pt175-tom-27, complete1
caacggggctgatttcttgccctttcgggcggtttgtttgccctttcgggcggcttgcttttcagcaggctgggtacctttccgcacctgtgagtaactagctttcgctggttgcatggcggtaatactctctattaccgccatgcaaccagcgaaagctagttactcacaggtgctgaaaggtacccagcctgctgaaaagcaagccgcccgaaagggcaaacaaaccgcccgaaagggcaagaaatcagccccgttggaagtggctttgggtaagttgttgcccggagtgcatttggggtggttgggtaaggttgtggctgagttggccaagcctagccctgggtctgcggaggcctcgcaacctccgttgttcagagcgctcactgctgctctgaaggtgattggcggccaggacatcgatgctgccaatgcgtacaggaacagctctgccgtgaaagagtacgtgggaaaggtctttccccgtccgggaaacgccaagcagagcgaggggccggcaacgaacgtggctccgttgaacagcaagcagcgtcgggcgctcaagcgtgccgacaaacaggccgc

SEQ ID NO: 2153 - DNA, 585 bp, Hubei polero-like virus 2
  strain QTM26674 hypothetical protein 1,1
gtagacggcgaaccgtcaccccaacccccccctcctccgccaccaagtccggaaccagaaccagaacccaaaccagccccacctccaacgaggttttggggatatgagggtaaaccaacctcccgagtttcaacagctcgcaatgatcagttcatagatgtcaaacctttgacatttataaaactgtacaaatgggagaatgaacattggagtaatgaaaattttactgccaattatctacaaaatgatcgcgagaaagcaaccccctatttcctaatccccgcagataagggggaattcacagtctatatagagaccgatggggaatacaaagtccgtgcaatcacagatcctaacaagggtaaatgggcaggctttgtagctttcaacgcagatcaagacggctggttcgcacgtgagtattcaggagtcaagatttcaaactatcaagctacacgtagctttgtcgttggacatcctgatgctgaggtcaataactgccacttccaaggttctcgagcagtagaaagtgattactactgctcctttgacctctccgtggccgaggatggtgcttattgggct

SEQ ID NO: 2154 - DNA, 585 bp, Hubei levi-like virus 9
  strain WGML141493 hypothetical protein1
cctcccctttcctccatgccaccgattctggcccctcacagggcggtctttcggtggaagtgacatggaagaaaggcgggggagggggggtcacgcccgctgacatggtgtcagcgggctatgccggcgaaccggaagggctacctgcccttgtgaggtgaatccgtggagagaataagagaacgcgttactggtggctttacaaccgagaagaccatcaagatctcgaatggcactgccacccgagtaaactatgctggcgtcaaggtaacgaagaccatccaggacacgctgactcctaacttcacggccttgctaaaatgcggacaattccttccgctaaatccagtacgaatcaccactgctactgaaacccgagtttcttcgggtgacggttgcaagatctggcccaattacaacccgggctacatctattttgatggtgatgttggtggtacgagcttctttacgagcgcgtattgccctccttggcccacgattggtgacaacgacggtttgattaacgccgctgtcgtcgcagcccgcagtaatgcggtgtctgatacgtgggatgtgttgacgttt

SEQ ID NO: 2155 - DNA, 587 bp, Mossman virus
  complete genome.2
gatcaagtcagccatcggtgggagtgttagagctcttccaatattcagttcatcactaggtaacctataagctcattagtaccagaatgtgatatgtttccgatacggggtgtcacactatgatacacaacagcgatagtacagattagtagttatatgcaggtctctaatacttaatggtacgacatctcaatcagacaaatcattaagcaccagccacgatcagtgtctcactctatagctacaacaatgagtcttcctatacagaccttccaagcactgtatatcacacttataatgggtaagggctagtttcagtcagatagtatatattgtttgggttaataatctaacaacaaaaaacttagggcaaaagaccctttaatcctggatctctgtacagtgccagacagaccaatccatagctccccactcacagtctcctcactagcaatcaccggaggattcgttgtggtaagtcatatagagctatatttatactttcaccaaattctatattcactgtcagcatccgctggatcttgtcttacaatctgttgcagggaactctatatctggattaaatc

SEQ ID NO: 2156 - DNA, 588 bp, Beihai sipunculid worm virus 6
  strain BHNXC41400 polyprotein gene,1
gtgcgctcgcaaaatgcgagcgcacacctgcaggtttatgatgttgttcttacgtcttatgacaacctgcggtggttagaaccaccttgactcgaactgagtcgaattaaattttaacgactgaaggatagacggttccccgcccgtcgactcctaatcggtgatccttaattttgatcgtgtttgacgatcttgatatggcccgtttgacgtgcctgaggtagttttcttagtcagaaagccttagggattacacgttagacggaattgatagattttatttcacgagatttgttttggtgaaacgttgacctcggcctgagcctactagatgatatgaaatctcgcactttccagtaccagcggaaatccgccgtactcagtgttagtgcagtgattgatttgatttaagttttatcagtttgtcgacgaataaaggagttaggtcccaaccttacaatagggatacctaaagaattcagacccgtgtaatgcgggccctcttcggaggtgtttgggctagtaccccactgataccacagtgttagttttactcctacgactgatttaaagtcatctgctcgacaa

SEQ ID NO: 2157 - DNA, 588 bp, Victoria bee virus 1
  isolate VN2-2 polyprotein gene, complete cds.1
ctatggccacccagccatagtattgcggattagcgtcccattaagattttaatttagctattcacaaccttttgttctttctttgattgacttaagccgctgtgtctcacccttttttgtaacctatttatttttctccggattaatatttagccgctacatcccaccccctccacctcgattgcccatttacgacggtttttctgttacttcattgtaactgctctctctctctcggaatttcggtgatctctcgtactagcatagattacgagaacgatgccaatttgttgacttcgctcttcttttgctttgacgaatacatataagtcacgtacttttaaatgtccctttagacatgtttattaaagggaaagtgcgtatcaggatatgtatcaggtaccctgaaagtcataaggttagactttcacattagggatacgattacggcccagaatcattggattctctgggttatacgtaatacacacgcttattacaagcttctcttcttagatgttaatcattcaggcgaatggaacgcgcgtctcacgaccgtaagtactaatagccaatcacgaatttgaa

SEQ ID NO: 2158 - DNA, 589 bp, Chaetoceros socialis
  f. radians RNA virus genes for non-structural2
ggactcttccatcacccatttatatgtttgtattttacatatttatatattaagtgtttatttcttttgctgagaaatatgtacagaccactaatgtctataaactataagagtgtgcagtctcatacttgttcccacgggaaattgacgtgtatatattagtgatttagcgtatttaatatttatttgtcgttctgcatatttttacgtaccctgtatattacattttcatagaactttcagtctgtctagcccatgacttcactgctagatttgactataaacatagtgataagtcggttctacatttacacaattacaagccgctggcaattgctttacaaatattgccaaccgtgtgggaaaatctccagaaaatacacacttgaaaggagatgagctacctcaggtttattcacatcccagagatgatccattggaattagatatttcacctatccagggactacagcgccaggttacgatcggtaatctctcatctgaatctttagagatatctgaggaaattcagtcggagaaagtggaaatacaaccacttgatgatcgtgagagagaaattacagaatta

SEQ ID NO: 2159 - DNA, 590 bp, Elephantopus scaber closterovirus
  strain pt171-clo-1, complete1
gctgcgtacagcgaaagtcaaggacttgaagctagctccgagttttgactttcgctgtacgcagcgattacataatttcgcgcatctggcgcgcctttaataccgttggagtcctgcacttcttcggcactgatacaaccactacggtggttaaggagttttcggctgctgggccgatcgtccctttacggaaatcctgttttccgttctctgttcgcgctgctgttcgcgcgattaaagctgccggacgtcctattgacgctccgcgctccggatgcctctgtggcctccctgttatcgacacatctggtgtcgtgcgtccccgctctgttgcgggcgtttggaggtatgctctgtgtaaacctccccttactgctgccgccaagaggtccatccgcaaggcgaagaaagattctgcattctttctcagccgggcttcttctctcttctctcgggaagtcccctgcggcacgcgtcacagacttcgcaagcgtgttgcgaaactagctgaccccactgtgcgtgaaagtccccaagacaagactaaacttaaggggcgccgacatggcaaaaactctgacctcccgtat

SEQ ID NO: 2160 - DNA, 592 bp, Wenling triplecross lizardfish picornavirus
  strain XYHYC1852461
ttgggaaatccccaatgcttctttcaacaccgcctgactatgcggtggcgcttcggctcaaacaactagtcacttccccctcttaactactacccaagacttctaactacccttacctacttatttgtctaaatttcaaacttttattctcacgcgtcttataaacatcttttctatttgttatggtatgttttgtgatttgtgtggtgtatttcatttaatgggatctagtggaccgtgccccggttgggtatccgctccctttaaatgtttgcaagcactcttgacattataacctatcatttagtttacttgtttgtatgatcgtatttctgaatcgtaacatttatgcaattctttctcgccgagacttgtctaggagataaagttcctgcatatttagtgttacggttgtataatggagacttagatagcttcacactgaggacgctttttcgctatccttttgacctgattcaggccagtgtggagttaatgattgtatggatgggccctacaatttgtctaagacttggtgatagcctcgcggccgctcgccatttatacaactgaatagcggttgaaactctct

SEQ ID NO: 2161 - DNA, 596 bp, Wenling crustacean virus 2
  strain WLJQ102135 hypothetical protein 11
gcggaagaaaaaccgcacacatatactaagcataaatcgaaggagatttaaagtgaagcatttatttaatatcgtaacaatgaatgtgaaggagccctttttatgttaatgtacaaacaaattgacaaccccccgtctacgcagacattaaatgctgtcttttatatattgagattaaaataatattttgtgattatagaaaacacatcaatttcttactccagagatagtaggagtctaaaactaatacaaaaccgaaatacactattcgaagtaagttctcgagggtagtgttatttcaaacgggacgcacaagagctaactagttaaagacactcttgcccacaaattgaagttccgaacgctgtaagaccgcaggacccttttatattatgaatactactattacgaatgtagtcgttagaatatttatttatataaataccaatcttcaatttctttatcgtatgatagtgacattttgtcatttagaagattactttatatatatatatattactttcaacgtcattttaacgtgtgatcttatataatgtcccatgcatttaatgcggctattagttcgctcataaaat

SEQ ID NO: 2162 - DNA, 597 bp, Odonatan anphe-related virus OKIAV59
  cRNA sequence.1
ttgcatgtccagtaaccacacatatatcacgtcaatctcgatgtggtcattgtctcagaaaaacagaagggggtccttaattggcaattgtttgttcatacttgaatctcctgtaaaaaaaaccttcgagtgcctttatacttaattaagactagtaattatattttatacacataattttttatgttatacaccatgcatatacacatagctgtatctcttatcacattttaagaaaaaccgaacaaaagatggatcgagccggaaacacaccacaaaacccacatggagccatcagggatagtggatggatcactgtaaatggtcaactaccacctaatgacctagaacctcctgaaaggaagggcggaattacatctcaaccggtatacggctattgtaggcggtgtgattccgttgtccaggtcaaaccttctcccttttccagtcattatcgaaatggtcgagtaattgactctaagaagtcatcagtctgtgttactccctattatctaaccccatgagagaataaaggcacctacttgactcccactgtgagaagttgagccaaacgatttagaaaaacccgagtccaag

SEQ ID NO: 2163 - DNA, 597 bp, Rhinolophus picornavirus
  strain Henan-Rf265 polyprotein gene,1
cggaacgttgtatgctcagggcgtaggcaccacccacgggtggtgcctacacgtgtggactaaaccacacactcttttcagcacttagtgctgctatctctttttgtaacttagaagtttgtacacaatgcgttagggccacacatccagtgtggtatcgcaaagcacttctgtttccccggtgctagtaggagggtggctgctccacggccacttgccgaacccatcgttacccgactcattacttcgcaaagcctagtaacccagttgaagcaagcccggcgtgttccggtcaggaaaaaccccccctggccagaaacatgtgatgagggtgggctatccccactggtgacagtgagccctccctgcgttggcacatggcccgatctgggcgtggttcttgtggatgctgccgaagagccccgtgagctagtgtttataccgccggcctcgtgaatgcggctaaccctaaccccggagcagaggctactgaagccacagtagtcgctgtcgtaacgagtaattctgggatgggaccgactactttcgagtgtccgtgtttcctttattcttttattgttgtttatggtgacaaac

SEQ ID NO: 2164 - DNA, 597 bp, Wenling crustacean virus 3
  strain WLJQ142924 hypothetical protein 11
tttgaacccacgctgtctataagtctagtgtaaccgtggctgtccccacgctgaatagcatgtgaaaccgtggccgtagaatgattgtacacttctaaagaactgtgcaatatttaacctttttcccttacgattttattctatatatcagaagcaagcgttgattgatatatactatacttttgtacaatggaaaattgtattagtttttaagattttagttataagcttctatcttctcctatatgctagttgactagtaggatgcgatctcctcttgaagaaacacacagcggattcgaccccgtctgttggcgcatttcaggtgattattttggaactccgttatcttcggaggtaggcaccatggctagaacccatggcggcttgtagtctcttataacttttgatccctcgataggcatgagcaaagtagcttagaataactcctcatgactggattgttagcgcatttcatccagcgcacttggaagatgattttatgagatatacgcgagccgtagaaggtcagtccctgaaataagggtggcattaccggaaacgctatcaccaattgaaagccgcaacccatataac

SEQ ID NO: 2165 - DNA, 598 bp, Aedes aegypti anphevirus
  strain 1a, complete genome.2
tcgtctgtaggaactgtgtcttagtaagattaatcataatagtataacggtattaatctaatccttttgggtgagttataaccatcacctatctgcctaaacgtatctagtgcgatctatgtgtaagttagcctttagaagctttataataataataataggcatcggaagcaagtgtggtatcattataaaaacccgccagttacaaatcatgcctgtttcaatagcttgtgcacattgccactatcccattgacatccagtcagttggtgctcccagtgatattgggataaactgcaagatgtgtggaaaaacatcatacgtaatcaatgccccattttaacatgggtaggtagaaccgccacaccaggtttatatttatcttttgctcaagcacaatgcaacctagcaaatgcattaatatatctatatattttgaagattatacatattgtgcagctacattatcatcactgtgaggcttcttttctttatttatatttggctaatttattcaatgtataggttctcttgcttataaaaaacccgccagttacagatcacttgtcgtgtatttggaacattgaaaatcgaaaat

SEQ ID NO: 2166 - DNA, 600 bp, Scott virus
  isolate Antarctic6 polyprotein gene, complete cds.1
gcgggttaccccgcatggcgttttgaacgtgtcaaccacgatacggttgctgtaggggcaccagctgtgtcccacctcttgctagcggagctcgttagccggtgccggtacgttaagtcggcaacataggagttagttttatttcttctttactatattctttgttttccaggttgtctgcataccgagagctgctaccggtgcgcccgccggggttaactgcatggctagcatgcagctgtggccgccaaaagtgcagatgtagtgactatcgttgcggtctttgatttcagggggcattgtacgcatcctgtatcgaacgggtcagttggggtaggctacgggtgaaaccccagtggtatcctaataatatttattaggaccagaggcacgctaacgcagcggataatggtgagtttcaagggacaaaaaccattcaacgctggggctcgggtgtcactcctgattcgcgaatacatggtgtgtacaatgtgataactcttgtcattgaagaccccatcgtaagctacaccctatgcgtttagggctactcaggggcatgttaggttttaaagcccatatgtttgttagtatgccagg

SEQ ID NO: 2167 - DNA, 600 bp, Hubei narna-like virus 22
  strain SZmix20730 RNA-dependent RNA1
ctagactggtcatgtattttgtgatcatgctacgcgaatggcgagactgtcaattaggacagcctcggtgtagatactgatagtatctccgggtctcttatatttcagtaatgaaaggaggagaatactttggaaacaaattttgcgttaagcttaactactctaaccaaagtaacaaccgcagtctgtaaagcactacgatcattaggtttgtcaaagagaaaagaacacgcaatcgaggatatattgataaaacaattgtcctcctcggggcctgagtatgttttaaaacgcttatccgaattaacggactggcgaaagaaacatctcgagggagagctaagttacgctcccgcatggcacaagaagagtacgttaaaggatggaacaactaaaccatctgataggctgggaagccaagtctggaaattatcagacaaagctttcttttgtgtagttggttgcttgaggaaaagtatagagttaaatataccaaccgaaaagcagctttctaaatggttagagggggtaaggtgcgaaatcacatcaatacccagcaagactataacgctatccccaccagttgaaacaattgactgg

SEQ ID NO: 2168 - DNA, 602 bp, Kummerowia striata picorna-like virus
  strain pt119-pic-7 genomic1
gccagttcagggctgtaatcctgggaaatggaccgaatccatcagtgatgtagacctgttttgtacggaaaagcattcaggttagatcaccgtttgttgggatacgttaatcctcacacccccccccattccatttgtatttaatgtttagccgggtggtgtccggtatataaattaccaatgtttaacggatttgtttgtgtaccttcggtctgaaatcctaatgctggataatccttggcgtctgtgtttcacggtcttggaccctctttaggtgaatatgattgcaacctgtcggccctcttcggagcgtttagacatatcatattcttgggtcgctagcgcttgctctaaaccctcttagttgaaaattagagcacgtacgaactttagtggtcagggtgtacgttaaccacctataaaggtcatgtttatccacatcgaccctcaaggctaaccctttgagttaaaatcggatatcacttcgtcaaaattcgtcttcggtttctgcctccgcgtcttcggtttcggttagcgtatcttcggcttcgattcatgctttggaaaagcgtgttgagaaattgtctcttattgtgactaag

SEQ ID NO: 2169 - DNA, 602 bp, Wenzhou picorna-like virus 12
  strain WZFSL74240 hypothetical2
agtgtcgcaacgaaagcaatgccccctacctctttgatcgtccttcatggtgggaaccgtgttggaatgcattgagggtggagagaaaacttctttaggttagtatcgatatccaattttgtgcgtggaaagcttgagctggctgaccacattttgcacttacttagcttgcgaaccaaaagaataatctagcgttcaatctgcttaagattgacagagagaggtggtatcctctccaagctgacactgagcttgtggataaagacagtggggaaggcgtaaaggttcaacaggaaactgtccggtttcatgacaatcaaaaatcttattcatacaagattccgactgcacctgataccattgctgaggattctgctattgacgcagcatctctcggtgagtttttgagccgtcccgttaagattggaacagtcacctggagtgaatctagtgcggctggtttagcaacatccatatacccttggtctgcattcttcaatgatgcacgcatcaaatataagcttaataattgggctttcattcgatgcaatttaaagatcaaggtgttggttaatgcttccccattttattatggagcagca

SEQ ID NO: 2170 - DNA, 602 bp, Wuhan insect virus 30
  strain WHZM9934 hypothetical protein gene,1
caaaaatccaagttatacatcaagccaagagacaagtgcaattataaataattaacccaattacctacagacaatccaaatatatcggaaaatgaatccaactttaacaggtggcacaggcgaagcaagaaatggtcaatgggataagagaagaaaacaagcctggctaaatgatgcgctattgctgctcgacttgaaacttgggtttactatcaggacacgatcagactcacagctacagatgctagtatcaacatttgcaagcaacgagaagttgaaagagtattggcttaccttgggtgatacaactcatttggtacagccggccggtagttcagcctcatcgtacggtactgcgtttgagtgctcatactcgggaatgtttcgagaaaagtacttagagtgggtgttccaagacaaacaaatagttgacgaaatattagaagcaataggccagccaaagctgtcaatagtgtagacccctgaggagcttagcgaaacggcaatgccgtagggtcgcccccatttgaaaaaagaagtaactacaaataacaatagctccaacaaataacacaaatacaaacaaacaaacaacgccaaaa

SEQ ID NO: 2171 - DNA, 603 bp, Halhan virus 1
  replicative protein and structural protein genes,1
gggcaataccctgcgcaatcatttgaactcacgctgtctgtaaatcttagtgtaaccgtggctgtccccacgctgaataagtatgtgaaaccgtgaccgtagaatgattgttcttctttttgaactgtgtaatatttaaccttatatctaatattttattgatctatttatcagaagcaagcgttgattgatatatacttcaatatttttgtacgatatactgtattaattttaattttctttctcctactatatgttagttgcctaataggatgcgatctcctcttgaagaaaaacacagcggattcgaccccgactgttggcgctcttcaggtgactattttggaacttcaattatttgaaggtaggcactgtggctagaacccacagcggtaagtagattcttaattttatctaattatgttaggcatgagcaaagtagctttgaataactcctcatgactagactgtattgtgcatttcgtctagcacacataatgaaataactttaatttaatcgcttaccgtagaaggtcaaccccattttatgggtggtattaccggaaaacgctatcaccaattgaaagccgaacccaatataac

SEQ ID NO: 2172 - DNA, 603 bp, Perrin Park virus
  strain PPKV 205644 hypothetical protein gene,1
atatacagtagtcgactaagacatccgaatgcagtatccttaatgaaaagaataaaacacccagattgtacactgtacacttattagagttattacttttaaaataccacgcgtacatacgtgctattttaaaagtaataactctaataagtgtacagtgtacaatctgggtgttttattcttttcattaaggatactgcattcggatgtcttagtcgactactgtatatggcgtgcacttctgctgcctaaggaattattgcgaaacccccccttctcacaaacacacaaactcacaaatactctcgaactcatcacaactcgagttcagtttttatataaagctggtgtctgagaaacagctagtcgcgagctagtgtactatatgtcatgtctatgtagtacagtttcaacacgtatctttgccttatatgaattccccacacaaaaatttccttctgagtacgcctcccggtttcataccttactgaaacacgcgaggacaaacggccgtggcctctcagtcgtagctatcaaaactttatagccgaacaccgctatggcaaccccatggttattaggcaattctgaaaatcttaaact

SEQ ID NO: 2173 - DNA, 603 bp, Sclerotinia sclerotiorum
  negative-stranded RNA virus 9,isolate W45,1
tatagaaacagtactactcgtgagctactagacagctgaatctcacttggactgattacattcgtacatgctaatcacacttgtcctctggcaatgcatccatgtgtagttgtcacgcaaccggatcacattcgtacacattgtgccgaacatgcatttggcatttatacagtagaagacctaattgaagacattgatctgtacaatcatgaattggctcaggcacaagatacaggcgaatggcgacacttcaatgaaatatggagcaataagataaacgaaaagaatttggatcacattaatatccttttagtgcccagtattggtttaggagagctcattcaatcaaggagcatcatggcattggttcttaatgacagttccttcagtttgtctctcagaggaatgtcgatgcaggataaacctttacagattgagttcagagaccagagcatgatgtttgaaggatatgtgaaacagttcgaaataattagttcgctttcatcctttataatgacttatatgtgaaattaaaggcacaatacaccgttgaactacacataaaaaaaaccgtttaaagcttagttctcttttaacactaca

SEQ ID NO: 2174 - DNA, 605 bp, Hubei picorna-like virus 20
  strain WGML146806 hypothetical protein1
ctttcaaccccgggttcttttacaggtcttactaaccttgtctaacagtaatgttgacaaaattagtggtttttaagtgcgaagagctaggtttttccaaaaaaccgtacacttccgtgctcgtaagttcagcacgcctaatggaggcaattcttacatccatgagctagcaactccaactgctttaggttttagaatagattgttcgaattactgcatcaggaccatctgtcctttcataaaaccacttgttgattacaatccgctgtcagttaatattttgcactatatgtgctaactctgaccaggtgagtaattagtaagaaccatcctccatcaaagtcacaactggccacgtttgaatacgctgtctgctttgaggtttggattcaattgacacattgcgcggcattgatgttgattgtctgctgagctagcttagtgacactggggtcaaactgcttgtgctatcgtgtgataacgcgttacggcgtctgcactggtatgacgatgtccagtgactcgagttaggggaagtgcctaacgttctatcgtcacttaccttaaactttccgtttcttacggacccacagctggtaacacat

SEQ ID NO: 2175 - DNA, 605 bp, Wenzhou picorna-like virus 39
  strain WZFSL83776 hypothetical1
gcccgagaagggcttattatgacgtgaaatgaacgtatgagttgttaaagctccatgtttaaaatgggggctctatattgttattttatgtttaaatataagatctgattggaactcttttcggtaaataaaaggagtgtgttcactagtaatgtttggttcggtttttgttattaagagatggagttaaaacatatacagcttcaaaagaatgaagaataccaacaaacgtataagttttatgtcccatacttatagtattgtgtataaacattattcgtgacacggctagattatcatacgttatcacgttgcagcgcgtgtgcagttttgaaaggataatcattaatagcgtttgttttttggctgtagctcttttatagagttagaggtttataatacaatagaatcttaagtgattcccataatgtccttggttgtattttaaacctcgaatacgtgaatgcaaatactcgatacctaatagagttagctatgctacccgttgttgtatgagatggtatcaaatccaacggagttagagaagttgggagatagacctggcttatggttagtttcacgtattttaggttgtctaaaacgaa

SEQ ID NO: 2176 - DNA, 605 bp, Hubei reo-like virus 10
  strain QTM136127 Minor structural protein1
acccaattatattacctgatattgatgatatacattacaaatacgcttttttaagtagtttcagaaataatgtttttttacattatcatattactactaatattaatagttttagttattatattaatccgcttagcaaatcattgactaagggtatcagtagatattatacggtccctttgaatgggaacacattttttgattcgtatgttattgatgatgttgtattttcacttgaaattaaatcagatggcgttatattagttgatgatcaacaagtattttcccttaataatggagttaataattacactacttgtacagtaagatttaaaactgtcccaaagaaagattctaacaatttactaatagttactatttatttagtcgaatatgaaaaaatatttagtaaggacccattaaagaatgatgaatactcctttaatagaactattaatagagtttatactaggtcatttggtgtgtccgattttaataaggtttttgttgatcctaagaagtcgataaatgtttttttatcgctggatacatttaatgacatagtgcatgactctttatattctattttcattgctcgatctgaa

SEQ ID NO: 2177 - DNA, 606 bp, Mint vein banding-associated virus
  isolate NCGR MEN 454, partial1
cgtaatctgatagcctgagcgattcagaattcctccaaaccctgcctttgcagtcttcgttcctttcgtttaagttcactttcaatcctgtactttttcattttttactgcatcccatcccatcgttcatcaattcacaacccgcagaattcatcttctgcatttctcttcttttcattcttgtttttcgttcacttccattttctttgtgtctcaccaccacatcgacttttggctttgttttctctttgttcgttccatacttctcaacccgcagaactcgtcttctgcattttcgttttcttcgttttctcattttcgttcaaaaacacaaaaagattttgctttcttttcctcttttgtctctcacgagacccttgttgtcgttcacgcccagttgttttcacttgtttctctgttttccaaaacttttgttctctttctttcttcgttccattcactccggtttttcttcagttttgtttctctcctttgcaccactccatccttcgaacgttccattcctctttgttttttgttcttcatttccacttcttttcattctttttgtttccccttcgttccttcccacactcccatcgcggt

SEQ ID NO: 2178 - DNA, 606 bp, Chajerado virus
  strain Cx 1773-7 genomic sequence.1
cgtagatatgttcatgtttgttttgttttgtaatttagttcaaagggctatacctacccctgattagtaacaaaatataaaactcggtacagaccggggcaaactaatatagttatttaataatctgtttgaccttatcttatgttcaatgccgtgttcgcttgcgtttttcattcccaggaaaatgttccccataagttttcagattattgtttaattattgtttgtgtataaacaattattttataaggcaaggcgttaattgatttaatgtttataagtatacggatttttattagcacgaattaattccatggtgaccaccgactagtaatcgagtactttgagtacaaggccaaaagccctctgtataacatgtgaagtgtgttagaaatgataataaaatgaagttgaaagtaaccgcttaatgattttgaacgtgacaagcttctatgcttaaaatcatctcatatttattatgtaattcaatagatgtgtatctctacctattggatgtattcctctaaggaatagatgatctaagaaccggtcctttggtggtttcatacgtcatgaaatcaccattcctttttaaaattttcaatc

SEQ ID NO: 2179 - DNA, 606 bp, Macaca fascicularis picornavirus
  isolate KS018/MFS01, complete1
ggaggatactttgtttagctttgcaattcttaaactgttttccatttcactggtcgtttgacgcttgtagggcgacaggtgttcctagctcttgcttttctaaactatcgaattttgttttccactcgttcatatgtctatgtatgaatgaacggggtgagtcctcgttggccctcgctggagtgtaaattcccagtctttctggaactagaattacacaagactccaggagtgttctgaagattttcatatttaaataaaatcttttgggattgtccttgatggttgtagcgatgtctagtgtgtgtgcggattcccatgctggcaacagcatcctcacaggccaaaagcccagggttaacagcccccgctagatgcatggtaccccccatgcccattttggatatgaaattaaggtttgtttacttaggaatttcataaggaagcttctgaggctatgaaggatgcccaggaggtacccgctatatgtggatctgacctggggaccccttgcgtagctttactgcgtagtgtgggtttaaaaagcgtctagtagccttgttttcgggggaccgaaaacttccacattattttgagactggcatc

SEQ ID NO: 2180 - DNA, 606 bp, Wenzhou picorna-like virus 13
  strain WZSBei69459 hypothetical1
gccggggctctttgagccccggttatcgtttgagtagtctgatagaatatgtctatctgcaggtcttgtcattgtgcgagaaatgcacgatgatgatgttcttgtagtgttgcgaagtcttgccagtgtgcgagatcgcacgttggtgatgttctttgcttgatatttttattagtatgaacagcttggtgttacactgagctatatgctcggtgtcgccaccccaaactgcctttctactactcgagcggttacgcagccgttttctgcaggtttttagtcaatttatcctgcgcgtaaaaattaaatacactttcaacccagttgacgctttttaaggattttgcgtgataaatcatccccgcttctgcggatgaaaagacggacatcgtagatcaagactgtaagtccgtgggctgcatttcacttttgtgaatgtagctgttacagtcagttagggtggatatttagatgttttatgcattgtagatattcaccacatcgatcacccggatgcaacagcgtgacggtgcgtacatgtagaaatagcgtgtatgtgctgaatgttactatttccctcattttttgagagctcatttgtcatgt

SEQ ID NO: 2181 - DNA, 606 bp, Wenzhou levi-like virus 7
  strain WZFSL85855 hypothetical protein2
ttttagctaacttatcctctaacattattgtgttagatttatttataccttaggaggtacaaattggattatttgacagaatacccgattgataaatctttatccattatcagtcatatctcttcagtctgctctcagttaggtggacctctctcacaagaattgaatactcttgttcaagaggggaactattctgctctaatcaactttaaatttgattatcagaagccctatacacaaaacgactttatttacgcccgtcaaattcaagctcttgtttcaaaacaggagtttattgacttaggcgtagatcgagaagttgaagcgtataaaaccttttctgaggctgaggaattatgttcgcgtactaatgaacgattccgtggtagtctatctgacgtttcgtcagagtgtcactccgtgctttacggggcgacacgaaaaatagctaccatactcggagacgttcctgagtacagtgaattaaatttctcttttggacctggagctacaaccaacgttaaacgagcgcggtctaaccctagggttaaacttgaagctcctctaacttgtagtttcgaatttgttccccatgtcgcgaaattc

SEQ ID NO: 2182 - DNA, 606 bp, Changjiang tombus-like virus 11
  strain CJLX30677 hypothetical1
tggtgccgcgcggtgcttaatggtgttgaggcgcaagtaaaactgcaccacaggaacattaaggttacgtcccgtgtcggattagtgaagttgaggagaggtttcggttattttcgtgatgttgtgcaagacaacatttttttttataataatacagtcagcgtggtattgcgggctttgactgagcggttgtattacgttaagggtgtggatgggtttgtcccatgccctcgacccattgtaccattctccaggttgaaatggattcgcgaccgagtgcggagaggattagcagctgtgccgcctgtgtggacatatgaacaatttgtcaattcatacacaggtagcaagcacagacgttacacctctgccgtttccaatctagccgctagaggcttgagaagaagtgacggttacttgacaacattcatcaaagccgaactatacaatggcacaaccaaggctgacccttgcccaaggttgattcagccccgcagccctgagttcaatgttgaactaggacgatacttacgtccacttgagaaacttgtctacaaatccatcgaccatttgtttggccaccatgttgtacttaaatgtgacaac

SEQ ID NO: 2183 - DNA, 607 bp, Astroviridae sp.
  isolate rob180ast1nc genomic sequence.1
tgtgttgcaaaatcccacaaatcctcatatgttttctcaatttcaacaggatcactataatggaatttctcaaacatcttcgtataagctcgagacgtccaagttgtggatgcatagtcgtgttgttcataaggtgttattatccctagtaatggatctctcactttttttcaactatcaaggatggagtgaaaactcaaaccactatgcaaatggttgtcacacaggctcggaaaataaggaaaaagaaaccctttacatgtgctttttgtaataagacttttacaaactggcatgaccgccagaaatgtaagaaaagccaagagaaaaatgcagctgaaaagaaaaaagatgagccaaaaaacgagaagaaggggcagtagaaacatcgagctgccccgtttcggttttctcgtggtatgactatcttgaaaaaccctttggaaagatttgcctacctgaagaacaaacattgcttggctatatagcagttgacaaactagtggagagaactaaaaaagtgagagatccattactagggataataacaccttatgaacaacacgactatgcatccacaacttggacgtctcgagcttatacgaag

SEQ ID NO: 2184 - DNA, 607 bp, Linepithema humile picorna-like virus 1
  putative RdRp and putative2
cgtgttagtgtgatcttgctcttaatcggataaaaagagagaataataagatatagagtagtgctactaacataagggtcttagttatttagctttaccacacaaggtggaccgtggcagccccacaatatctagtgtagctctctaggatgggaacattaggtcgtgttctatccgaaattacccatggcctgcgtctaaaagtaataaaacaactaatggcaataataataccgctgtcattgatataaatagtaatacaggtattaatgagaaagagagcattggtcagagtaattttacagctcctcaagcacaaaattatgaagaagctccacaaatttctcaaacagttgaggagcaagtgcaaatcgtaacatttgatgatgataatgcagtagtccaggaacatataccatatgaaatagaagttccacgttttggaaatcaacaacacacggatcttttgacacattcagttgtgacgtttttaggaagaccgcggcttatttcatcatttccttggttggccgaatattctcggtccacgaatatactaaagttttcgaatcacggattgctcgtaccatcgaatattttatctccg

SEQ ID NO: 2185 - DNA, 607 bp, Fusariviridae sp.
  isolate H1_Bulk_Litter_4_scaffold_181
gtcaagatgcagcactatggttgtgtctacacttgtttgtgacttgaagtcgtcggactgtccactctgctccttgagacatggtggctttagcctttatgtcttaagtggtcgagttgacgggccctcgccctcaattctcattttatttatttgtttaatttatttggccacatagcccttgtgctttgtggagattatgatggtgcgctggttccgcactgacagggagttttgttttcctgtcagttcggggcctgtgaaccatctaatctcctcaacgctcatggtgactatgtgcgggagtcaactgatgccgagtatattattgaggttggcatggtgtttgccattccaacaccaataatgtggtcgggcccagatggtttcccacctggtcctcatcctgcgtcgccaaggttgtaggagtggctttgccgcccctgagatcttgtcgacgccggttgtggagccggtttgccactgttccccaaaattccttttcttgtctcattgtcaaatgcaagctgcccgaatattagctgagcggatgaagttcaaaggggaagcacccttacctatgccaccacgcgccccttggctgaaa

SEQ ID NO: 2186 - DNA, 607 bp, Sanxia tombus-like virus 3
  strain SXXX37381 hypothetical protein 11
cgccaattcttacgtcagtgtgttactgtttaacatcaccatggcttttagcactgaagtccaatggtgtttaatcggcatcgggttatgtcgtaccggtaagtatgtttatgattactttaacaggtttaaattacgggccaaggccatcaccactgctgctaattcacaggtcaatgctgtcatgcaagtgatgaacggcgacatctatgaccatatggaaattacagatgtcaccgaagatttgtctgaacaagttcttgattcatccgacaattctgttgtgaacaagcgtaggcgtgttagacaacgtgccccttttagagcttatttggtaaaaattggcaaagcaaaattcggtctgctcaaacgaactgaggccaatcgcatggttgtccgtaagtttctgtatgataattgcatagcacatggcgtgcttgcaagacacattacagataatattgacttcgccactgagatggtatttatacctacagagtccgagttgaccaatatggctatcaaatctactaccgttaatgttgagagtaacattgttgcccgcttgctgggcaccaatgatgctttcaattgatggggcccaagc

SEQ ID NO: 2187 - DNA, 608 bp, Apple chlorotic leaf spot virus
  VIC10 RNA, complete genome.1
ggtggaattactcaaacattttggatgggatgacaaggtgttgcaaagttacatcagaatgaaatgcacattgggttgcagactagggggtttcgccatcatgagattcaccggagaattctcaacatttttgttcaatacacttgcaaatatggtgtttacgttctgtagatatgaggttccagatggcaccccaatctgttttgcaggagatgacatgtgcgccctgaggaatttgaaagaaatcaatactcatgaattcattctgagtaaactgagcctcaaggcaaaagtcaatagaacaaaagtgccaatgttttgcggctggaggttgtgttgtgacggcctcatcaaggaaccttgtttgatatacgagaggttgcaagttgcaattgagaatgggagactgatggatgtgatagactcatattttctggaattttcattcgcctacaaattaggtgagaggctctattcacatcttgaaattgaacagctgaattatcatcaagttttaacaaggttctttataaggaacaagcatttgctaagaggtgattcaaggcacaacatctcggaactcgagtggctttcagacgaggatggcg

SEQ ID NO: 2188 - DNA, 609 bp, Wenzhou bivalvia virus 2
  strain beimix75763 RNA-dependent RNA1
ctttttctggccgcgcttttaccgtggtcggcataccacgtaggtctgatgatcaccgctaatcatttgacgcaaaaggccaagggggggggtgactattgcccggacgcacttgtgtaaacaaggtaagagggggaaggcatacatcaatgtccttcttcactcttgctatcgctgcaaggtagatttgtccgaaaacctcacggacgaggtatagactccaaacctcccgcccccgatcgtgtatcacatgtcgtgacacgttactcgtagttcttaggtctttgttagtaccaacaagtccatcccgcacccccctctggaacggctttgggagggtggcgcgtgcggcccgggcgctcctagcaaagggtgccagctgggttcaatcaacggttgtgtgttgcaccacgatcttataggattcgactcacccatagaactacaagtaaacatcacgcgtgcaatgacggctatcgcctgaaacaacgaaagggggcaaaactctttagaacatctgttctcatctagcggcagggagagggaattagctggcagtaaacctcgacctgaaatttttaatgcagccagggcgccgtttttactcta

SEQ ID NO: 2189 - DNA, 611 bp, Erysiphe necator associated ourmia-like virus 11
  isolate1
tggaagcccctttgctttcatccgtcgctaaccatttccggtctccaccaccctcccttccacgcggttacgtcacatttgcacgtaagatcgttcgacgcctgttccctcacgggtgggacgccggatcttacgagtcttgtgtgctcggaaccgatccttctttgtcagcatgtttggagaatcgccgcagtgcgggcggacttcacggctatgtttccaaccctcgggttgagaatcaactcggacgttttcgtcacgatgacttcctcacgacgtgcttagacggggcaacccgtcctttgagcgtcgcttcgggtctgactgtcgtccagagtgccggtaagcctcgcccgctgagcaaattctcggcggacgcgatacacttgagaccgcttcataaggcgatctatgatagactgtcgcgcgagaaatggctctgccgtggtgattttacaactgacgttctacagcgcgctggtttttcctttgttgaaggcgaagtcttgacttcgggggattataagagtgccaccgacaatctctctatcgaggttgccgaggctattcttgacgaattgctcaagtccacggtctctgtgccggggtcg

SEQ ID NO: 2190 - DNA, 611 bp, Wuhan insect virus 11
  strain CJLX30623 hypothetical protein 1 and1
gtgaggtttatacctcacacacaattttgacccatctatgggtaaaatagacgtccagagttttttagcatgcattctttgagagacgttaagcacatgaaagagcatgaagttgtcgatgtacagagaattcattctccaaggcagggcacatcttagtatataaaacaaaacgattccgattatttacgacgaaaccatttaagtattaatcctgacccgattttgatatacgacaaacagctgaataactgttaaaactattcaaatccaacggaccagtaatcttaaattacctgtgacagccgaagtttagtaggttcccaatatagccgtgaaacgcttgagggccgttacagctctaatttaagacctacgtttttaaagcttggtaagcgctttacttgagcaacatatacaaaactagtaccaaatcttagtggaatttaagtatgatatttgaatgttagacatgtattatgtcaaatatcctctacatttctacataaaggtcatgcaatgctcagtggttattgcattatggtcgcagttaacttgcagttttgtattgcctgtgtcggagcagtagtaaagtaaacagacgatttcac

SEQ ID NO: 2191 - DNA, 613 bp, Marmot picobirnavirus
  clone c214910_g1_i1_libraryA_2588 segment I1
tcaaagatcaaacttggctcaggagcaattgacggcttcaagagatcaggtggctaaggacctaggttatggtaccttagctgaaagtacacggcataacaaagcacaggagcagcataatgttaacgtccttggtgagcaacaaagacacaattatgcccaagagagctataatgtagcagtgttaggtgagcagacccgacacaacatagctaacgaagagctcacacgcttggctaatgaagagattgcacgaagcaatcgtgcacgagagagcgaaactaatcgacataatcttcaaaccgaagatgtggctaggcagcagttagttctatctcaagattcattggctgaaactgtgcgatccaatctcgcacgcgaaagtgaaacgcatcgatcaaacgttgaacgggagagagaaacgtttagatcgaatcgcgctagagaggaagaaacttctcgatctaatcgcgcaaaagaggatgagactcgaaggtcgaatctagtccgggagatcgagactgaaaggtcaaatcgggcgagtgaaggtattcgtcaacaacaggtgaatttaggctatgcgcagttaggtgagcagcgccaatatcaccaa

SEQ ID NO: 2192 - DNA, 613 bp, Beihai picorna-like virus 74
  strain BHHK130969 hypothetical protein1
gtgtgtttgttcaacacacatgttcatttttacccagttgctatgttgcaatacctaacttaatcagaggttatgttttagaaactcatgatattagaggttatgcttgaagaactcggtaagttgatatgttttagacactcagaaggatgaactcttgctggtcgtttattactcgttagtcattacgtctggtaccttcttgctcgtgagaccgatattgatggtcttctattactcgtgagaccaattttgttagctattgttaactcgtgaggcatgggatttattttaaccataaaacttatactaatatgagatggttttagccctatggaaatgcttagtacccttaggtgtgggaacacttttccaaagtcggaaaaacttcaaccgctgtgttgtacatgttgattgattttacatctcaccgctatgaaaaaggacattgctttattcatatgataaggacgatatggagccggtttagctacgtcgagactttggtcgtagacgcgtagtatgccaagcccattggtcaaactattaaggctctctggattagcaacccagtagtagatttagttttggtctgggcgtattccctgaagat

SEQ ID NO: 2193 - DNA, 614 bp, Serbia picorna-like virus 1
  isolate 71282 RNA-dependent RNA1
gtagtacgttaaacgtacgaccaccgatgagactgaaatgacactagttgagattatttcaatatcctagtgttataaagtcaatatttgttggttgatcgtttcgtcaatcgatggcgctgacagccggaaagacggcaataataaaaaccaagatttagtttttaagttttgatttgattgcaaaagctatcttgaatagacaatcaaaatattaagtattgcaaaagcttcttaaagaagacaatatttaattagttagtaaccaaacctcatcgtgcccctaagggttaaccggttacgtaaaagcgtagaggtattaaggtcactgcggagacctaaaatccgcaattttatgttttgtaatgttttaattatagacttagatgtaactataagagtttataaatacttgtttcaagatttatagacaagatctgatcctatggattttagataaccttcatgttagtggatagtgtgtgtacctatctaaacgcataaggctcttatttcatatttaaagtaggactatgtattacggcgcatctaacggtaacgttagtcaagaccggagaatctcggaatgaattttagtaattcccaaatttata

SEQ ID NO: 2194 - DNA, 615 bp, Wenzhou gastropodes virus 1
  strain WZSLuoI86017 hypothetical1
ctcgcacacgcgtttgcgtgtgcgaggatttcatttagtagttgtctctattttggagacacaattggtggacaggggtccgcccctgttacaccgtttgtcggagcaatggggtacgccccattgttccgtgctattgacgatttactttcttaactaggtatcgaaagtgttaaaccagctttcaccaaactttctacggagattgtaagattaaatctgacctgctagacgtatcataaaatccaatgtttactagtattgcttaaagctgtccgatcatgaggaagtacctactttcggatgtggtatttatgaggcccgtcacttggcctagtatgaaagaagtgaccaccaaaccagtccgcgaactatgttcgtttatagttatgatgtgtaccttttctaaggcgcgactatttagtctcacattttataaattggtgacaatttacataattatattcgtttagtgtgcggagagccgtagacctatggtgtatgttgatttgaaagagcttgctcttagtcagtacattgaaagccctagtggtgtagtaaaacataggtcgctttgtgaacgagaaaccccaacttttggggctttcagttcgc

SEQ ID NO: 2195 - DNA, 616 bp, Picornavirales sp.
  isolate H3_Bulk_Litter_17_scaffold_25321R
tgcgtatgtaacccatgcgcatgttttcatatagatatctttaaaacaatttgtagagaccctgcatattcttctttagaatcaggtatgagaccctgagtatttgctgttaagttttatttcgacgactattccgagaaatagggactctgtagccctggtattttgttctataactgtctggtttgtaatgaccttataaacatttcagttgttcataacatttgctataatttcagtataatatttctgtatgattataattttgcaaaaccccttttgttaatcacattttattcaaagcttcttaaatgaagttgcattagcattttatgcttttgctgtcagtctgatttattgttatatttacttattaatggtggcgagaattccactcgtcttgaaaacctttattttatatagaggtctgttttgttcacgctttaggtttcctatcgagcgactatgtgatgaaaaatgtggtagaaccaagtgtttcatcttatgcatacacctcaatgataggttgttaaaatctatatcacgctcgtgtcgtgaatgttgggtactctgatttaattgcagtaactttcctaaccgagttgtcatatcaacc

SEQ ID NO: 2196 - DNA, 616 bp, Hubei odonate virus 7
  strain QTM27298 hypothetical protein 1,1
atatgcatgggcttcccatgtatatcaattttatagtccgatccttattttaggtggcgagtatcctgctacatattttggcgagtacccttagcactggcgagtaccctatatctagtagacgattacccatttatttctgggttgggtgacccccttaattttaaataaccatcttatatcatattcattatttcaaatgttatattatatatgcttcctcatttattattaagtttgcttgatttaacaagtttgaactcgttatgaaacattgtctaagataactggattcggattctgggccagttatggagaaacggacgattgactgagagtaatggtgagactttttataattattcagtaacaactgtggttagtttgcggacgcccgaccgttctgtaccaattttattaagtctaaatgggcccttttgcaccttttggtccttaaggtctacagccattgcttgtagttacggacattcagacctccctgtttgatagcatctttctaatatttccagaagtatttgatttcatccccataataattttaagattgtgttttaaagtttttgaaaggttttcacaaaatctttcctctctggca

SEQ ID NO: 2197 - DNA, 618 bp, Permutotetraviridae sp.
  BGV/MQ/34/Bogor/2017 gene for ORF2, ORF11
aagccctttgtgcttcgtccctttgatcctttctatcttcctcttctacgacgacaaactgctcacccaactcgctaatactttctctgctaatgccgcgttcaagtggcttgggactttcatctctgcacataagaaacaaatagctgggctcatatttcttgtcccggccacttttctgtcgtgcgatcccaaatgggcaaccgtagtatctgctgtggtttcctatctggtatcagaggtgttccccgcccctgggaagtatttcgagtacggcttccttggaggttcactcattctattgtgcaccgcaaggaagccgatccagttcgtcgtcgctacggtggttgcgctgctaaccattggtcttgggttgtggggctcggaggtatttgcctctttgccctccacctcacgccagggctagcaatcagcgacatccctctctgcgaccccagaaactgcaaagtctcctgtactaccaccggccacccgctcccttggtgtgacacaggtcccactgtctactgctactcagagggcaaggagtgcaagcaatgttgccccttagctctcccaccgtgtacgccatggccgtcgtgcttcttcacgactacc

SEQ ID NO: 2198 - DNA, 619 bp, Biomphalaria virus 3
  complete genome.1
cgatgtatcggtaaatgtagtttaaccctctgtttctcgagagagacaggttggtgttctatgttctgctgcattgagaattgggctcccgttgtattgttgtacaaattgttgatatgtgttactcgtaaattttcagttaagttagcgttagaatttatgtgtctaccattataaacgtttgtatgtgatgtgttctaatttgatgtttatccctggtgttgaccgtgccaggcgatctgtaatatctgatgaagaagtggtgtagcttgacctacttgccctaaacttgggttttttattttaattttggaatacagctatttccctcctagttggattaagacagatggtgctgcttgacaatcagcatcaatcggtttggacgtttgtccagtcaagttgagtgtttagtacttgttactttgattttggaaattttagtgcctcatagctgtgagacaacactattagtccttgtcagagcgataaaggcttttcatgagacgtaagttgagcaattatgattgggtagcgctggaaatccgcgtagctcgtccttgttgaccatccatggtggtggatcagattgcttggctgacaaataaccacagatatt

SEQ ID NO: 2199 - DNA, 621 bp, Nephila clavipes virus 2
  isolate SC, complete genome.1
acacattcaatttgaaactcatattcattcactactgctccttggagcagtttgtgtttaatataaaacccaatttatatgttattatatgtttgttttgttttgtctgactgtattagcactattaacgtgccagtcgaaaagaaaataaaaatagaaaaatataaatactttataaactgttatgatgtcatttgcgaatgagattgaataagtacagaaagaatgttgagattgaaaccccgtttgagtccccaaagatgcatgctatattatctcatactctttgcatttttatgaatttcaatttatattgcaaaaagaaactaacatttcaaagttattcgagattgatgttctataagaacttatatccttcgaaaatttgttagtttaatataacgtacctaaagtaatgaaatatttaataccacccctcctttgagtagcttaacctctcaaagatcccgctgtggatttgtattaaatatgtaatgaaatgtgggaattgtactttattaaataacgaatgattagagcttgcccgattgaatttaggcttgttcaaattgatcgcttgaacaaagtattagatcactttttatggatttagtatgaata

SEQ ID NO: 2200 - DNA, 621 bp, Picornavirales sp.
  isolate H4_Bulk_47_scaffold_9 RNA-dependent RNA1
actagagacctttaacttattttttgcatcagtacttgtgtataaccttactaataccgtcattaaaactcaaagtagatttaatgaagctgttattggatgtatatttctactgattgaacagactttgtttgttccgtgcatggtctcaaaattaaaataaaataaaacaaaataaaacattataaaattgaaaatacaaaatattaccactttaaagatcactagaatgttttgaacatttctataccaccttatatttattatagagggctctatctacgagcacctagcgtttacagaagacgtaacttttgctttagcactttaaccttgtgaatggaatattggcggagggacctatgaggaagtacctactaacctcctttgttatcaaattttctgagtcgatttatttcgatgtttcatagttgtggcgcactcccactaaatttagatactcaaaacccaatatgtggcattcctacgttgttagagagttccgcgcaggcggctatcgcgtttatttaatagataaggtttattaatgtaagtagccattcttacatgaaatactaatcaccttctattatctaaaaccctgttgtttagctatatatt

SEQ ID NO: 2201 - DNA, 622 bp, Rhizoctonia solani beny-like virus 1
  isolate BR2 polyprotein gene,1
catccagtgtagcagcctaccatgccaagtatgtaaaagtccattttttgttctctattgctgagaaatttcttaacacgggccaacagtatttgtgtatggtgggtggatctcctttcttcggatcgtaggcgtctggttgagacgccatttaaggttgtgcaaggtgggcgtgtgtcgagacattcacgtaatcatcttctcacagggggtacctaaagcccccatggtcgtagacctttaggtgaccttagaaaaggcacgcgggcgactgattcgttcaaggctgaggagtctttaagtgttcttacaaggacacgaccgggttggaaaagccctctctctacagagagaaaagttgacaaagtccttacgcgataggggcgactttcccaatagggagtcccagtcgtaggctctactgttcagcttcgcctttcccaatagggagtagcagaacacgttcgggtaataagggcccatgttggtcaccaagtgcgaatgagcaacggaaagttttcggcaatcggatgaaagcgtcttaactctgaaaaagggggccacccgtgaggggtaagtgccatgtgcgtggagtttgaacggcgatctggaacccggtaag

SEQ ID NO: 2202 - DNA, 622 bp, Beihai picorna-like virus 4
  strain BHZY60671 hypothetical protein 12
atcccttttgccttggagaggcgtaaaatctaccagctccggaactattcgtagcataagtttaaaatagttgtgtatatatggatactacatattttataatttacatgtttatatattttatggaagctttgtacatatagacatcctacccttaggataccggtatttactggaggtttcgtcaaccagggaaacattgtcacacacagatacagtgggtactgttctgatgtggtgtttatattaaatattgcctacttcacttaataataataatacaaacagtcttagaactgactcaaatagttctcctgatagcgcttatagtgtctcaaaagcagctcaacaggtttcaacgcaaaatgtacattttgttgatggagacacgccatggtcttacgacatttcatcatcaccggatagcaccacccagctcgcaggatttagcgatgcagaactcggttccttcctcggtcgtcctctcaaaatcagagaatttcagtggactccggaaagcactcgattgtttgaaatttttaatccgtggactgatttttttagtaatacagatgttttagagaaaataaatagatatcgtaatcttagatgtaatcttaga

SEQ ID NO: 2203 - DNA, 623 bp, Picornavirales sp.
  isolate rfb198shi3 genomic sequence.1
tggccgcaatcgctagtgctattggtgctcttgcaggagctgggattaatcccaactctattatgcaagctggtttgccttttgcccaggcagcccagcaacaaaattatcagcaacaaaatattcaatcttattttaaaggagaacaaggtttacaatcagatgtacaaaatcagtttactaaagctggcttgccttcttttatggcttataccggtggtaattcaggttctaacagtttgccgcgtcaagaattttcattaggcggcatgaataggttcgttggtggaaatgttggcgccaatatgccttccaccatgaatgctatgcaacagtattaccactggggtaacccgtttggaagttcaggtcaatttaatttccaaggagtgaatggttcaaatgtaccacgtaccaatcctataccaagcgatgcaaggcagaataatacaggttctacatttacaacaccagacaatgctaatacaagatattccacgcggggaacaccagctcaaagatcgactgctgaaggaaccactgtccctggagcttttctcaatacctagttaaaacgtcattgagagaaatacgtagttatatcttgcccagaaataactgca

SEQ ID NO: 2204 - DNA, 623 bp, Cladosporium cladosporioides
  negative-stranded RNA virus 1,isolate1R
aggtttcagtaactattaaccgaccgacgggtctggggattcttaattagtgggatggtataactatcatgatccgtctaattctgaatttctcgtaaaacaaatcttatttctaagacaaatagaaaaaaactcgactgctatagatccaatcattcatcattgtcactcgatggattccaaaaggatctactcagaggaacgatttctcatatccgtgatacgtccaacagatccggaagaagaatatgtagagattgatatattcactgagaataacatggacaatccgattgaaatgacaacaggtgaactccatgacattgtaactgataaggttccatttatgcatatttagtccactgtatttgtactctccacagacagggagaaggtactgatgtctgtcactgatagaaatgtcaagatccatttcctgaatcgatttatcacaatagacaacatgaggtttgatttcaattcaatagtactggctatttctgtagacagagaagaggagagacagagggaaatgaaggagtaagaaggatgatggaatctatatctgtcattagttcttgataaactgctatgttattacttaaagaaaacccgattgcatc

SEQ ID NO: 2205 - DNA, 624 bp, Phomopsis longicolla RNA virus 1
  isolate KY RNA-dependent RNA1
tgcacgggtttagcccggcccccggatctgacgcgtgcctgcggactgttgaagtaggttgtcgtccttgcaatgtgagtcgattaaagagattatagtgccaaaggaatctcgcgctctcgagcgttcggcacttgcatgttccggtgccgggctgcgggttgacatccgcggtcccgttcccccctaggggtatttaaccggtgggtatgctagtaaggtccggccttcgggttaatgaacgcatattaaaatcttagatgtattcctcgagaggaacgtaagaacccactaggagatgctccaggagtggaccgtagcgggtagtgccgacggcctgggtggtggcggttgtgaaacaccgcggaagtggatgtaggggcgttgcatgtaatgcagggttagaaacctgccccgagtagcggtgtcgctgactgtgcctcgcgcgcgagtgacctccccgtgactgtgtgttcgtgcacggcgggttcttgccctttgggggccgcgaaaggttgtgtggacatggtcgctacctttcctaccacacccaaaactccgggacaacgaagtccctgatgagtataaaagcgaattgaaaatagaccccaaaagaaacagaac

SEQ ID NO: 2206 - DNA, 624 bp, Wenling picorna-like virus 6
  strain WLJQ101512 hypothetical protein1
aagaagtgagactttaaaacactttatggatcgcaattccattctttggtaaaacttagacaaattgtagcttgcagatttattagaagagtttatagttgtttggcaaatgataatctttatattgcttacaattatttcacctttcgtgccgtattgtactctagttcaaaatcatttgtggtttgctattctatttaatgttatattagttgttttttatgctatagccattgtacatgtggcaaacgttgttatacatgacgtagacgacgattaatatggttgttgttattaatgctccttttactgaagggggtgtttctagggttgggaaattttttgttttagttttcccaaaaaaatttaaatgtaggttatttgttaccgtgtaccacgagactttcagctgtcaagtgggcctatcatgttggtgctattcccaggagaataatccgacgagtcattactaaaaatgctacccattgtcaaaaatggagattcgaggagagaactgctaaggccaagttgcttcaacaagtgcgggttggtatagccaatagtgttaggaaagagaaggagaaattgcgtgatgagaaatttcagtatgagtacgagcctcag

SEQ ID NO: 2207 - DNA, 624 bp, Hubei tombus-like virus 10
  strain WHCC112361 hypothetical protein 11
ttagcggaccgcattttgtctgcgcaaagtgacctagggtttgaagaatatatagaccgggctgactatatcaacgccgaaatgcttgcggatgcactaggcattgatgccccggattactcgggagaagaagagttaaaggagaagttgcggaagatagaccagaaagtcaaggaaaaggtctgtggtacaaaggagctgcccaggaaagggaaggttcataagcgcaaccgtgcgccgttcatccgttcaatggtaactgaattacggatggaattcccgttcaatgtcactgaagataatgcagctaatcgcctgtccatgcataggcgcgctgttcaattgatgaagaatcagggactgtgctctgcccacattgttcgcgatgtagacttgattgttgagatgatgttcgtaccactgcagagtaacattgaagcacgtgaatgtgctaatacatgggctgtgagaaacgacatcgacaagtataacgccaggatgctctccgcctggtatgagtggttactccccaactggctgttgaatagacagcgggggagtgcccatcgcgccgcttagggaggcccagtgaccgtactcggaagggaagagactggcattaaa

SEQ ID NO: 2208 - DNA, 625 bp, Picornavirales Q_sR_OV_020
  putative non-structural protein1
gagagatattctctcacgtgcgggtaaacgatatgctagtcgttttaactggattttattcagtttatgattttaactacgtacatgctagcccatggcgtgtgcttttgaagtgataggaacttcaataatgcaacttggaaagttgtatcaatggaaggattttcccaagactgtgtcttggaaccaccctattttgggttggggcttgcgcggcccctttactcttagtggtaagtccttcgaccacctcaacgaagtaggcagtagtaggcgcggctctctgagcctcgtactttatgcttcagcaatgaagcacagttttaaactggtgcgtacctacgtctcacaagagaacttgtgatttgactgagtacttgtcctatagtatggaacattttggaattgatgaaccgatttggaaccgctatagggaacggatttgattcccttggattgctttgcttgaaattgtttctgagtgttgtataacgtttctatgctgtccgtcttgcaggacattaaggtatagaatttatcggttacccgggccggagtttaagtagatttaatgaggttggcaccttatcattatttcttgcaacatttcaggctaagatgatgg

SEQ ID NO: 2209 - DNA, 626 bp, Schizochytrium single-stranded RNA virus
  complete genome.1
agtaaaaaggtgtgcggggtaatcccccgcacgcctttgtttgtagaatgcacttatacagattccgctcttgccgttaattataccgctcttgccgcaatctgtcaccagatccgccatttccgctataaacgccatttacgcaatctaaacttgttttctctttcactaggttatgctcacctaattactcaaatttgctacaccacccacagcacttgattagtcaccacttgctgcttgtattatatagactcttttgtacacatttaatgtaccatatttatttaccaattatagaagaaaaataaaaatcaaataaccagaaaataaaaatatttatagacccacaatgtctttaaaattggactcaactctatttctttgccgatttagacttgtttgaacctttattccgaactcctcttgtatatacgaggctagtaaggtaaagtgatatgccctggacgcatgtatcgtcctgtttgtgagtaaagtataactctctccctaaaagtttttacgtttgtcagggataagaccgctagtgatgtatgccacggacacagaagtcctatatgcatttaattccactagttcataacgtacccccccatcttaacacc

SEQ ID NO: 2210 - DNA, 627 bp, Aedes aegypti anphevirus
  strain 1a, complete genome.1
gcctgcccacagaagatggtctacttccatatcagaagatgcagaggagaggtcatcgacaccaaccacccccgcggtgtgtatccatactttcatactgatctaccagcgaaatttcataataaaaaacccgctagttacaaatcatgtctgtcattgctgcattgtgggcatctgggagcgtgaccttctacaggttcttagaccacttgatcaagagccttaacgggggtataatgttcgacccccagccggacggatctctcttcggcccacccagaattcacttgatgagtgtgtcgtcagagggacttgccattctggggacaatcgcattggctgcatgtgttgggtttcttatagataactggcatgagtatgtgactaggcagaggtttcgcgaaagggtaagaagccgattgtctcgggtggattactatacccccaatgagtgagtcatagctcgccccaaaatcctcagtgctcaaattgtgacccactggatatgtatgacacacgatagtgttacatgtgaatgcgctttattttctagctgtgatatttttatgtttttattagtaaaaaacccgccagttacaaatcaataagaggagtaacacaggaacg

SEQ ID NO: 2211 - DNA, 627 bp, Frankliniella occidentalis
  associated mononegavirales virus 31R
gcgacgcaaagtgtaccttggtgcatagtatagccatttggcgacgggatttcccggaaaatcgaggcatttgcctctggccatttggccctaagtgtttagtgtgtgtaggaaagtttgtcgcttatttccgagcacatgtatgagttgtatataataggtctcgtaactggggcggcccttgttggactagcgtggtttataacgacgcgcgtgcagcattggctcattgtgcgaggactaccggcccacgtcggggatcttgagttacctagcgaatccggcatcggatattcgctgagttctttcgatctcgactcggttgatgattaggttgtaagccttttggcgtcttagttttcggcctttcggcgtttagttgtaagtctgacccgtttgggcctttagttataagttgcctcttttggcttattgtaagtttccctttcgggttagttttaagccttttcaggtcttaggttctaggtccattggattttctattgtagctttttagcttttgttttgtgcccccttttggggccgacccacgtttggcgtggcttatctttatgtttgcttaattgtaggttgcgccgacttaagtcggcgcgttgtagatttaag

SEQ ID NO: 2212 - DNA, 628 bp, Beihai weivirus-like virus 12
  strain BWBFG40815 RNA-dependent RNA1
tctccttctcgtgcatgtcaccttggcactggaattcattttgggggcgtcggcattttgccggcgagtagggagcgccactcacgccggtattcgccgggggggacgtgaggctgcgatagtcggcagcgcattttgctggtgtaaaatagggaggccagtccctgctccccgaattaccttcctgtcgtacgttcccgcgtgcggctatgagccaatttgcggcgtggttcctcccacgtgaaggtgaaggccaggggtgcggtagccgccggtatgcatgtatgtagcgatgattcgatcgtcgcgggtagtgccacccctcccgactgctcctatctggattaaaggttgaagttgtgcgatgatgcccaaactcgcacgatggaacctagggcagcgggcatggctacggttcggagcgcgtgtacggtccggggtcagccgtccctcggaaccccatcgcgtttcaggttagacggttagggtgggatttttcccagggcttttgtattagttattgcgcgcttggtgtttttccgagaatgacactcacatcaagttgtcccccttgcgcactgtttttggagcgaactgttttgcagttattagtggattttcgcccact

SEQ ID NO: 2213 - DNA, 629 bp, Ryegrass mottle virus
  strain GUNCC_DN53883-16 hypothetical protein,1
attaaattaactctattgaacccgttatccggtgatataggatatctgtgaactaacatcacaataatcagttagcccctcgatttatgccttcagtggttatcgaggtctgctcatacgacgaggagacaggagattgtgaacttgagagtgcggcgaagatattcaccagtaacttcgacgggacttacgtcctatacactcacagttccgggccgaaatacgccggatcaactgtcacactcgtctgccctcactgcggggtgagtgaacaagcgacgttcccgaccagaggcctttcaggcaactggggtcaccacgggccgcacgacttacgacttgattgtaaggcgcggcactggcacggagcgtgcgaggtcattcccctctctgagcaagagtcgcgtgtagcgtctgacggggttttcgaaccaggtctaacgcacatcactacgacccgagggcagtcttggactagacatctttagtccctcccagttctcgctgggagtcccgcagcctggctacgggaaatatcggtggggttgatcaaacctacacctcttcgagaaaagcgctcttcgagtactccctcggcagactattctgttgcgtctcccatagtgaag

SEQ ID NO: 2214 - DNA, 629 bp, Beihai picorna-like virus 1
  strain BHZC36988 hypothetical protein 11
ctccacacgggtttttgcccgtgtggagatcatcaagcttttatcagtagtaatttgcagttactcgagtcctctgtttggactctatttaggaatgttaatttaaactcaattcagtcgtcgatgtctctattgggtttattccctttagagttatacaattgtcttgagttttaaaaattgcatcactatttagagtctcgcattttgcgcatgactcggataattttactttattaccgattttagtttgtgatctgacccagttttctatctattcagtgtttttgctaaccatgcaataatatgtcgcactgtctacgccataaagcaagactatttataggtgcaaatttaactttgagaattctaggctttgaacttcttattagttgtccgataatttgttatcgccccggaccgggcgatttccttctcatttatgagagaaacttttcaatgtgctgagtactgatcacgtggaagcacactaatatgtccacatgaactatagtcataatcaatgaccctaaaagtccttgtccggaaaacacgcacaaggcattatccgcaggttttgtcgcgaatccaaaataggccggattgtagacctatcgaatcgcgataac

SEQ ID NO: 2215 - DNA, 630 bp, Isahaya Culex iflavirus
  17CxNGK-Cps gene for RNA-dependent RNA1
ataggtcctaacagtgtagatctgcttatttcaagtttttctagttttctgttggatagaatagtaatatattattttaatccatttagttcacggggctatacctaccccctattagtaacaaaatcatttaaaatactcggtacagaccggggtccaatttaatattcttaattatgcaattcgaccttatgataagttcaagaagcttctcttggttcctaataatccccctaggaatttccccttatcttttttgtataattttgattaactttggatgtataaaaattattattaaggcaaggcagatagtataattctgaaatgttacatgatttagattgccatttgaagcccctagataaatagttctgggtatgagttcgaggaaacaacaacgatgccgattttggaactacaatttactttatgtttcaaagtagggttttactagtctgtgacagcttttgcttaatacacgttagcctatgtgctaaaacttcgatgacatgtttatccatggacttcggacatatatctttaagatatgcgtgtactctgaaacgtcagatggtagtagcatgacgaagatagcaacctaccaattttcctttattttctttcact

SEQ ID NO: 2216 - DNA, 631 bp, Wenzhou picorna-like virus 52
  strain beimix75583 hypothetical2
tgtctcatccccgaccaccatgtcgttaaactggtcgcggcgcgcgtgagtgtcgtagccccacggggaagccaaaatcacactcatcgtagtggttacatacgaatacatgtttttgcttgtttatcatgattcggaatgcttgcgatgagaatggggagtattgaaactcgagtgctatttagttaccgcagagtcccactgcaattaaaatacgcgataggagtgttctaggaggcaagagcattaccggtataaattaaatcgtctcactaaattttctaatgaaatagagtctgctgaagactttaaaatcagcgggtatgtaccacaagctggcgagcctggtactactatagcccaaggcaatgggcaaaagttggaggccattacaggcttctccgaccagttggctggttggacgacttctatcacgggaggtcgtgacgctacgtataatttagctaacaataatgattccgacttgggagatttcctcggtcgaccagtcaaggtgttagagacacaatggtcgataggacaacctctttttgagcgttttaatccttggtatttgttcttgcacaataccagagtgaaagagaagacttccaactttgaattattgagg

SEQ ID NO: 2217 - DNA, 632 bp, Culex Bunya-like virus
  strain CBunVL/Fresno, complete genome.1
agtagctgtttattgagtaagagtttgtagaggatggatgattaagagtgtgagtgagaggtgtagttgtgcgggtggtaaggttgagagtggtggtgtagaggaaaggtggaggtggagaccaaagtgatggggtatattcactgtgtacactttgctcaggttctgaaaacgtaaacctggataagaagagaaagaagtactgcatttgtgacaaggccttcttagaggagcacacctgcaattgctcagctggagtagtcaaggaggagttcctgagacccacctttaagcattggcatttgagtgagcctctaaataagtacagactatcttgcataaacgaggagctattgaagaagagctcatccaaagggccagtggttgaccctgactacagagtatcctctttgtcttttagactaggttggccactatcaccattcagtaagagctcacttccagtgcctcgttctggttctctcacaacaccagagaaacccaaggctgttaaaggcgccataaaggctgagccgaaatctgagccaaatccatctactagcagacccagtagagtagctcctcacacacaatcagaagggactgctaggaaggagctgtttaaatcagac

SEQ ID NO: 2218 - DNA, 632 bp, Haldis virus
  isolate AbWando19, complete genome.1
ttccgatctcgattttatatcgcatacactcaacaattacccctttatttggattatcttctgccttgctttcgagcaggtgcattagacttattccttataattcttccacaaaatttttcttacctccttttggagggatctttttgcgcgaattatatattggcaatgtataatttttaattgactaatcgtcttacccctttttgtttgcataaacttgctgtatctgttgtactgcaagctattgcatatgatggatttttgtgctgtatactgtaagctattgcacttatggttccagcgagtggtttgtataacatttccttaaccacgcgtaagccaacaaaataattagtcctattttgttaactttttatcaattgactattgatattttgatgagttggcactcattattattatcttttgccaaacccctcaatatttaccctagaacgtcatcttaggaggagtttttattttctaacggttctttttagacgcttgattataattataaccttcggtacagttcttagagtttttagtatgttttgtccaacaaaacatgcagcctgtattaggtttacaaatactagggaaacgccccgaaagagcgatttgtggta

SEQ ID NO: 2219 - DNA, 632 bp, Beihai picorna-like virus 78
  strain BHBei73249 hypothetical protein1
gcgaaatcgtctatggttaccaattatccttaaattggcgcaggcggcgttatcgtctttagtggaaactactatagtgtcaccaattgcttgtttacattcgacgtactatttgagagtgtgagtttcctttggtcgtagggtacttttgtaccgaaagcagatgtgttttcctgctgtttaaggtttttatgatgagtcctccgagaggggttttgtcggcacccagtcgacatcctttattctggatgacaccatacacggtacaggaaagtgcttgcaccagtaggttgttccaagagcgtggatcacggatactgagtttattttaaaacctagtgtgaagcgtggcggaagacccttcctactgtaggcgcatgtcgtggctagaacccgcaattgcgcttagcaacaagatagtgatgcccttgagtgatggcaacgttgttagtgtgttatgttatgacgaccgctttctttggcattttgccaacgggacggcccagcagagacacgattagttgtggcatcctatgtagtttggatgatctatcttgttgtgaataacccggtgattgcacaccacctgggtttgatttcccgactggccggtgtgtttgtcgttcggttta

SEQ ID NO: 2220 - DNA, 635 bp, Thrips tabaci associated narna-like virus 1
  isolate ThassRNAV161
aggaacccctacggggtcacataagagggctactgtgcacccagctaggcttaaagcccgctgtcgcagacgtcttcctatcaaggaagaagtctgagatcgaacgaatagaacaggagatccatggagtcttcgactccttactcttgttcgactggaaatcgtttaacgatgaacataactacaagatctatagatctgtggttgtgtctatcatcaagttaggttgtaccaaccttgacttggtgacaacgtattggaagcagtttacaaactggctcttcatacgtgtgtcccggtctattactcttgaagagcctagccgggataaacaaaacttcttcttcactttaagtgatattcgaagaattcgatcctatctggatagggattatcccatttccaaacgaggatggtcacggatagcccacctgatctctacgagacagctggtggccgggtccgtacggatagagcgacaatctgtcgatcgattccgagaggtgactacgtcaccctttattgccgaccccgatttccttaaggagatcggggacgtcgcttacgtcatcgggagacgcctcaggcgttctcacggcgactttccttcggatgccggacacatatctttaagt

SEQ ID NO: 2221 - DNA, 635 bp, Verticillium dahliae chrysovirus 1
  segment 3, complete sequence.1
tgataaaaatttaaaaatctctcagcctctaatacgacactgacatggacgagttgagagagcgggccaatctgatatgctcatgggagcatgtcatactcgatagagcgataggatatatcgtattgccaccgggccatgggaagagccacttacataacaggataccaggcctagtagaggcagacatggtattcgattgtagaggagacgatgagctgaaacgactgcgcggcaaagcgcgggagaccggggagtggtctacttacgatgaagaatggagtaatagactgtcggttcgtctaactaatcatcgttgggttgtaatggtaccatctcgcgagatagggaacaggataggcggtgtgtgtttgggggtggcccaactccacgacaagcagtggtcagctaacgtctcaagtcgtgggaagacgtctcgtgactatgaatacagcaggcaggttggtgtagatgtattgaggttcaagtgcaataaagacttagcagaatggttactcacagtggctaacatatggttagatgtgtgagcggcctgaggagtaccccccagggggacgaaacgctggtcgtagccgcgggcgcaagctaaccaacacatactaataagagacaac

SEQ ID NO: 2222 - DNA, 635 bp, Changjiang picorna-like virus 7
  strain CJLX30780 hypothetical1
ccgagtgaggacggtgttcccacaaaattataaaaaccccaatgttagagaccagattctttacgcgacgtactattttagcgtcagattctttattatttctatttttagggttttatattggcccgattgtagtatgactacaattaaacagtatacgtcaaatataagtcgaaagacaacgaatgctttcattatcattattcaactataagatttacaaaacacacgttgttatgggcgtaacttacgaaggctatttagctgaggtgatccccggattagtagatgttttgtgatgatatattgttgccaccattccagagttttcattaattggtaggagacaagatttaagcaggttgtgacaaccacgaaaggatgaacctatgatatcataatgtttgattagtgggttgcaatgaagaatgcgtaatccaagtcatgtattcgtgtctgttacctccccctgttaaagatgtgacccgtggtcacatttccacttatgtggcgccgtaagctatattggcgtgtagctgaggtgacttgtttagtccccacgtatgattactcagagagtgtgagataaaacttgtttaaaagacaaaatctaaaaatatttctgtataatcaaa

SEQ ID NO: 2223 - DNA, 636 bp, Bundaberg bee virus 1
  isolate QLD-6 nonstructural polyprotein and2
catgcttaattgctatataatagattgaacattctataacaaaaagtttcattggagttcaccagtgtcgaaaaaccgtaatgcagattcacgttaggagtcagccgtccgtggtccgagacgttaaatccgacaacgaaagcgatgtagtaaatacaaactaggaaatgtaatggctgaataacagtattgacaggcgttataaacaccttatggaaattatgtatttaatgcgtagccgtaggcagcttggatgtgatcggagtgaatgtgcgagtatgtgtgtgttttaacacattcgcttacgctatccaagtaatgaccgtagctatttagctttactgctcaggaccggtcggtggcagccccactaaagtccagaacattaaaataaatcaacaaattcttcaatacaccaatgatggtccaagtcagaattcttcaaccttttataataattccgaatttgatcagcaattcttgctttccgctacagacgggaggcaacatacaataattgattttttggaacgacctttccctctgacaaactttgaatggaatgtttcgagttctcagttttctacgctgtattctgcagaatttcctgatgccgttttagctcagccattgtat

SEQ ID NO: 2224 - DNA, 637 bp, Forsythia suspensa tombusvirus
  strain pt110-tom-8 genomic sequence.1
gttctggggcgtcgtcgagagccttaagccgtggctgtgttgtgcccgtcaggatagtagtgaagttgtggagaacatccgttccgtcagagcccgcccgggtgaattggcggtggtataccttgactacacgcacgaccctaagcaccatcacgtcaccaaggggttcgaaagtcttgttgtggtggataatgaacaagatggcgcgacaggacgttacccgcccgctcctccgccgcctgctcctgctcctcaacgtgtacaagtatgtccagctcaaagttacttggcgcaactcaagggccgctacggggactataaggacgcgctactacgtagcaagtctaaggtccctcgaagagaccctgtcgcggttgcccgcaagaagaagctagacgtgctagtcagcaggaatgtgtgcctcgcagaggcagtgaaatccaagcagcaccactgtgagagtgctgatgttctcagagagatcgcgagtctcaatgtgggcaataggagcgcgcccaaggtctgggatgcagttgagaccttggtggccacgacggtggccgattgcgctctgggggtcgcttgggaccctccggtaccgacagtgacgagcccttctgggccgccactaaggtcc

SEQ ID NO: 2225 - DNA, 637 bp, Brejeira virus
  strain AR800224 hypothetical protein 1, hypothetical1
aaaagggggaaaaaaacctaaaatttttgggggtttttttaaaaaacccaatttgttaagcttcaaatgaactgaaaaccggtattacgaccaaagtagtgcacgttggccaattttagaatacagtattttacagtatccaagattatgcttctccctaaagagaagcggacaagactttacggtagtatagtcttgtccgcttctctttagggagaagcataatcttggatactgtaaaatactgtattctaaattggccaacgtgcactactttggtcgtaataccggtttcagttcatctgaagctatactaattgggttgttaaaagcatcccgtaatacttacgagtttcatcgctcgtttaatatttctactctttctgagcagaataccacccctacaactcttaattggagttagtaaacttttcacaccttatcgtgtgaatacattgttttccagttagctgtgaaaactgtctttctgcttcctgttattcaggaagctcttctttgagactagctgtctctcttctattctctcgtaatcgagagaatcctgtctttggtcctcgcaagagaaccactactgtcttgaaggtttcttttgaagccgtcttatcttgatcttcaa

SEQ ID NO: 2226 - DNA, 638 bp, Beihai tombus-like virus 18
  strain BHZY60611 hypothetical protein 11
cgcacgttttccttgtcattggtaaccaaatggcaagcttggattcgtccttgagcgagttaggttgaatatgcaactgacatgaaccatttcggtgggtgccgtaacgcaaggtgagtggctgaaaagaccacaccggtgttacttaccattgaatgttgggcatttgtagcgagagatgatagatgtgggaagcaggggccctgcttgcagaacaagtggatgcgaactgaactctagcgacagtaagggagtatctgcttgcaatgtgagtgtgcgaaacttgtgaaacacattgcgtaatcaagctggacttgggagtccggtagctttgttgctgccggagaggcgtggggaggccaccaccaagtaaccaacgatgtagcacttgcccggcatgcgccttctctgtccgagtgtaaagacaatacccttctgcggtaccttaacactggagtgatttatgtcatttgctgataatgcttgcaaatcgccttggggtaatgtccgctcttaggctggtgtacatcggtgtaaaccgcagtaggtccctcccgatgcaccagttgttgagcgaactgcgcctgggggtgtttttcaaattagggatgtgcttatgctgccctccttcatgaaat

SEQ ID NO: 2227 - DNA, 639 bp, Wenzhou tombus-like virus 2
  strain WZFSL84050 hypothetical protein1
tcgacgtatcattttcccagacccgagcgcatgatgttcctctacgctgtgcttgttacctgtttcttggtgtgcatatggagactctgtgtgggcagaggtgccacagtgaatgctaacgcactggagcggtttgatcgtgccaccctcggcgatgagtcgagcgtcgatggtggtcacatgaccagccgccctgggtttgctgcagcaatggcgtgcaaggagaagctaggggagctgcgctacaataacgccaacaggatggtggtcggcgattttgtgcgcaactacctcagagagaactaccccgacatgaggaatgtcgatagggtgaggcacgctgccattggtgtggagttggcattggtgccgacagtcttcgcggtcgatgcagctggcttcgccagtgatgcggctgtgcggggccgtcgcgcaatggcaagtggacccaagtaggggtgccctgtcacatttcctgctcgggatacagctgttgaggttgaagctgtacctgatctcagggagcgggaagagtgtgataggggaggtcgggccaacggccctgatcgaacggtgcgctacctggctggctttgggactggagtcaactacggcgtgcatcgtaactcggctatcaac

SEQ ID NO: 2228 - DNA, 640 bp, Guadeloupe Culex tymo-like virus
  strain 2016-Ab-CQM, complete1
aggggctgaggcactcaagcactctccacacccaggagggggccgagtcgacgtcatcatcagctgaatcctgcgtggcgggagtgacgttcgatggctgctgtcggggagccgggagcaaatcaggaacgggggcggttggttgctgaaggaaaggaagcaagaagaagggttccagttcgtcgactttcatgacctgcgttctccattcaagatagaagcgcttcgggtgaaggtagttgtagtactgggctacttggcagttttgagtgtagcttcgagtggcgtaccagatggctgcggcgacgccagatccgacgcagaggagggcagcgtagttcttccaatgactacgaggagcaagctgcgggaaatggttcagcacccgagttgggatttgccgcttcatccagtcgataggttcaaatttggactcgcttcggatcacgctcgagctctggccggtaatccatcggggaagcccacgccaatacgcggtgaaggggttgattgagtcgttaatgaagttgtgcgagcgtatacgggctgacgctatcgtgactgccttgtgaattgccacatacgttactcacgttcaccgttatcgtacaaaccgtcatacgctccaaattttgccaac

SEQ ID NO: 2229 - DNA, 640 bp, Apple luteovirus 1
  isolate PA8, complete genome.3
aaactcgagacccagatggcaatatcctctccctacaccctggcggtttgaatgccatgggccgtgacctacagcagttcgaaagggatgctgtttataagatgtgggtcgagggacaagcagaggatatacggcgaaaacagattgagactgatgccgcctcagcacgttctatttctgagaacgactaccgccagataaaccaggaaatacgagctgccgagctgcctaaccaaccgaactttgtataccgggacgaccctattgtgaagcaaaacagcacgtctgatttcattgctgcacgtagggctgatttcgatgaacaaagtgtatcggatttgaagtctaatgcatcaactcggacaatcactgggaatcttggtggtggcaaactgaagaagaaggcgaacgaccttgatgatgttgaggacaagatcttgaaggcattaccagaaattgattataaaccttcagaaatcctcggcgtcaaggcacggtatcatggaggatgtggcaagtggagagatacctttgattcttccatgaattgccgttgttggatgccaaccctcgagtggcaacaagttgattttcaatacaaggggaaagcatccaagaatgagggaaagtctattatttc

SEQ ID NO: 2230 - DNA, 641 bp, Agaricus bisporus virus 14
  isolate AbV14-003, partial sequence.1
attatttatcggttattcgtcgtcttggaccctaccagggcacggtgatcgactttggctcgatatagaatgcgcgggcttgatgcctactagtccaaaagactaggaagagcgacattttcttctgtacgatatttctatcgtctgtcttgattgacgcaagacactacgtgtattattagtttcttattctcttcagatttctcgttccctcacgggtaagactgaattacagggcgcgaccctggagaatcaattatccttccggagcttccgcccccactgctcctctcccctcctatttgtccgtttaatcgaaatggtccgcgtctacgtcagccagcgagcgttataaatgcaggccgcccccccatcactcttacacacaaagacaattacatcatatgctaaactccattgactagagctctggatgtgactcgcacttgcctcgtgattaaagatcgaaatagcaaccggtgaaatagtctagtacttaatgactcgtccgagaagggcgacgagagcctactagctatgggttatcctatattccgtgagtttcgacggcctgaccctaggctttgcagtatctgttgcgagctaccctcattctttggtaactcaagcaatcaaatcgc

SEQ ID NO: 2231 - DNA, 641 bp, Beihai picorna-like virus 56
  strain BWBFG40791 hypothetical protein1
cctggcgaggtgatttttcttccttcattgttgcgcgtaaactctgcgcgtattcgatgaagggtcttttttgtgtagctttaagttttcccgctcaatcgggttgattatatgcatgttcctttggaggtcctgtaatatagactgcggattgtggctgagccgtcatttagatcgttccctactttctttatgccttgctggtagaagccagtattgaaaatattacggcgcttattgtattaatttaacctagcgaattgctttgttacacactagctggcatgcatgcctaaatgcaaactcttaatgttcgtgcgtaaccatagcgcacctgcccatgctcagatagtgtggtagctcctggctagatccaggaacagttgtagtatagaacctgctggcacacagattgtgccaaccaagtcaacaggtaggcatacctaaatgcaaacccgtgtagaaactttttggcataaagattgtgccaaccaagtaaacaggcctggctgacccaggactatgcgttaaaggtgttttcggttccgtggtcctgagtggcctacacgacgggcgcatagtagtcccctagggacgtgggtgcacactatggtgtgcatcaagacaataagccgaacccc

SEQ ID NO: 2232 - DNA, 642 bp, Circulifer tenellus virus 1
  complete genome.1
gtcatccaccgaccggtgggtgtttggcttgcggggaaactcactgctatgcaggaatggaccaaccaaacacacaagacaaacacccactggcaccccgttggtgctcagtcggtgtatggccatcccccaactccatgcaaaattaagggcttgggggatgctaattagtatagcacacaacgcaagatgtcttgccacatgcgtcccacccgggggaggagttccactgcctacccctcagggtttatgaggacgtgcccaaaattcggatgcttggtacatcagccagatgtattgggcatgccggtgctaagtccaagccacgggcgaatgcgacctggaagcttggtaaatgccgagagactgcaacgggctagggggtgccatttggcactgcgttgagcaacctgaatgtggtgaggtacagtccaacagctaagcgagctgagatgatcacatctattgcgtttgcttctaggtgtgctcctgcgttttcatccctattaagggctgtgttctcctccgtcttcaaactgttccgcattcacttgattcagattttagtgatagcgctttatttgactcatttgtgtgcgtttcaatctgttttcaagacggaccgatcgcgtgaatctgggc

SEQ ID NO: 2233 - DNA, 642 bp, Hubei picorna-like virus 69
  strain WGML147773 hypothetical protein1
gttttacctcactaaattaatagtttcaaacacgcaatacccaatctactagttatggcagcagcagcagcagctcttttaggtggctcctccattggagcagcctcacaattaggatctacagcaattagtgccaatgcacagcgtgaaatttctgctaatcaaattgaacaacaaaaatgggaaatgatgagaagagaaggagcatttacatcgcaagggctcccctctttcttagcttaccaaggtggcaatgcatatgtacctagaaccgttagccatttaggaggtacgaattatggtatatcggggttcaatggaaacaatctgccgtattcaccttcactcaccaggcagatgtatggcttttacaacgatcctttgcgatcaaggaccgaggcacctgccggtcccgttggtgatccgcagtttcctggacaaaccgacagaatgggattaggagctggaaggtatagtgcagttccaccaccaactcacatcggaactcaaacagaacgaacccatttccctagtagaacgtttgtaaacagtaaccgactttaatagatacctgactcattgagcttcatctatcgcaatacccaagtgattgcgaaatttggaattcgtgaatcattcaaa

SEQ ID NO: 2234 - DNA, 644 bp, Citrus leprosis virus C2
  isolate L147V1 segment RNA2, complete1
tttcatacatgagattggtatttgctcatatggattttgaattttatctttggttttatggatatgacgactcttaatcttcatcggcagttacagctgcgcctcggcccggactgtatttggtggtacctggaatgcccacacctttgaagacagaatactctatttcatatgtcgcaatgatatttattcatattttgtgtatcgctcagccgattttggtttgagcatttacacacacttagtttgagattatctgtacgtttatcacaatgttgattgacgttttagattctctcacgtatagtacgtgggctataatcggttaaaattttaaccgtattatttcctaacatattcgagatgacttgatctcccgtccttctcagtattgctataccgtttaacggtgttgagataaactggcgtcggtcgattctcagttttaccatcttgtttggtaactcttgtatatatgtaaataggtaagggttcttgcgtgccaagagtcttctgtattaatgtagtggactgctgcttcgatagagttgcagcagtacttgcattgatatgtaaatacacagagatacatatcaatgatccactccttattatggagacaaatcaaggtatgagttcacaca

SEQ ID NO: 2235 - DNA, 644 bp, Raspberry mottle virus
  isolate HCRL Glen Clova, complete genome.2
gtcgttttcttaagtggggtagttacgtcttaactagtagtttccagcccaacacgcccgttcctctcggtgctttgttgtcgcctccatgcatcagcgagaccctatcgtcacttcgtcgatgttagtttcttgtcctcgatgctctagcttctacgcaaaatttttcgctctccgttagtttcagcgatcgatcgtctcattcttcatctctctccccttttgtttctgacggtctcttctttcaagcttccgagctcggtggttctttagttaccctttcgttgtcaaggtctctctctggtctgctcctttctcttcgcgcgtcgtccccctcagcctcaggtatacgcactcgcctcctagattctattgttgtgtcgagtttgtcccctgctatacacttttcgttgaagttacctaactcccgcggtgagtcactgtcgtctactgtgactttgggcgctcgggtactctttcttccgaagggtgtttataactccttcgcgatcggcacgtccttttcggtcgtttcttcgttgtcgcgtgtttttcaaaaacgaccagagtcgcgtttcgcttaccgtttctcctcccctgacgtgtctctgtcagaccagtttaggttttgtctaccgctaatc

SEQ ID NO: 2236 - DNA, 644 bp, Hubei picorna-like virus 45
  strain spider133521 hypothetical1
ggtagaaacccggttcccttttggtggttgtgacatgccaccagctcaagtgaaagaactccgagatctggtatatttccatttatgcgaatatttggttatgtacggattgattcttttgcacttgagttcaaacgtccatttgttcttccaaaaacaaatgtttatgttttagtgtcgtcttgtatgtatgtgtgtatgtttgagagtatgaatgttatgagttgaaaaagttacaaacacaagtcgtgttgttgttgttgaagttgttgttgttgttgaagattgttgactttgtgtatacaactttttgctcactgtatgtatttttgaactgactgtacggacgtcgatgttatgattaattctaagcgtacctaaagtagtgaactttaagatatatcttaatagctgatgagatgcctatgaaatcttggtaggatgattaagttcgatctatcgagttagtaagtggcggtcagtgatttagcgtagctctgtatcttattgtaagcgaaatgtgggaaagcatgctttgcatacttagttttatgattaacggagacagactttggacctgacctccagcccttgcgcagccgctggttgtattttgcgcacccccctgactaattgctttcaaa

SEQ ID NO: 2237 - DNA, 644 bp, Beihai weivirus-like virus 13
  strain BHZY60103 RNA-dependent RNA1
ccgaccattgcggtcgggtgtacagggggtgcgcggcgttcgggggcttcggctaccttccgcgcgtgttttagggggcacatggttgggacgaccatgtgagtagtgtgcggtgctcacgcgaacccaggcgttctggccgtgaggtggtcctacgtgaccacgcagttttggggcttgtgtagcttgttcatttgccattttggcgctgtcgggacggttcacgtcccgactgactcccgtagggtcactaaagccccgtgccactgtaaaatagggaggccggtccctgcacaccgaattaccttcctcatcccacttcccaggtggggtgtacgagccaattagcgggtgcgtgccagcgcactgaaggtgaaggccaggcggatgctgttacccgcagctatgcaccgctcacctgccgtcctatccggatgaaggcgacctccagcatgattgcccagtagtgctgttggaacccgaggcggcagtgtggatgactacggccctcagatccccggtttggccgctggggtgcggcgtgaatcaagtaacggtgggtgtgccgtcttgtagcgtcctgaggtgggtacacaccaatgggtgggtcgtgactggggtccgacctagggcaatttctgcgc

SEQ ID NO: 2238 - DNA, 645 bp, Darwin bee virus 6
  isolate NT-8 nonstructural polyprotein and1
cctagggatacagagattttggacaattatttatattacagcttatatttggactaacagctggttttgttacttggtaatacatttaacatctaaatccaactgttaggaccagatagagtgaggctttatacacgccatttgtgcagggcctcatgggactgtacaatctaagagaatgtataaatgccttagtcgtatttatgattgttcatcaaaaacttttgataaattttatatctattttaaaatttatttaatgcatttaaatatgaactaggagtaaagttctatagtgaatagcttatctggggtagcaacccgtataactatagaagtaatatgcctggttcctctatttctgactgtgtaggaatttttatggagaacgtccaactaacagtggcgcttatcctaagtttcgttagtaaacttgcctaaagcttttcgatcggtaagactcgcctagttgcgacgacagatcacaatgttttaaatttaagggagatagtcctcttatctagtgattcagtattactgtgattattactatatctattaagcgtaacgaccttagtacgtatagtaataagagttctaaatgatgaagatttgaagaaatatcccgtagtcgtattgttaaat

SEQ ID NO: 2239 - DNA, 645 bp, Beihai picorna-like virus 76
  strain HOU156700 hypothetical protein1
ataaaattccgtacaacgattagtcgccgattaggtgctttgtgaggtattcacccaggcctagtttcgtgcgcgtgctaggttgctttggctataaaagttggagtagtataagcagcaaactcctatatttaaccctcattgaggggtacttgcaatggctgattgccttttatggagggtgcttgtaatggcctattgtgcgtgcactataggttcctaagggtataaaagtattacttgtatgttccattaaaaggttcagttcctcagggtataaaagtattgcctgtatgtctcatgagggagtgcgacaccccccttttaagtttcagtttaacttttaatttgatgatttaggttctggtgtctgaggtattacaggttgcgcgcctggacagcacatgttagtcatgtattatggtgtttaccaacacgtatctttgttcctaatgattcttttaggtcaagataaggaattgtgtgccccttatctgataagctgaacaccttgggatacggtcctggcgtttagttacagagacacatagccccgtggggttccctcgtatcaaatcgtataagtggcgaaatgaaagcttagtttctttgaaactagcaagtaagaatagccaaccctaagaa

SEQ ID NO: 2240 - DNA, 648 bp, Yam asymptomatic virus 1
  isolate VU567Da, complete genome.1
atataaaaactaaaaaatttttaagaaaaaccaaaaacagagtgtttgtttgacttttcctttatttgtagtgagtcagttgtaatttcgctgtttccactatcttatttttatcgtgtttttccagtgtgtagttaaagtcaagtcgttgatttggtgatagtgtgtcgattgcgcaccttgtaccggatttcccgaattgacttattagagtcagtaggtttgtatcggtctcgtttgtttttctttgtaactgttcctgtctgcttctgtaatttttaatttcgggtttatacgcatttgtgtattcgtgtggtttgttcagtttccagttgtaacctgtattactatttgggtttgtcttattaccgtctacgttgttgtttggaagttcccggaaaccactttcttcccaatcaacacacgtcagttgttgttcattctccctgtttgtttcgctattcctgtcagtagtgcatccactgtcatcctcgaacactttagttttacagtttcccatttttacttcctaacactcttagtctttccgttcgtttaattcctttttgtgtttcaaaccgtctgtggttttaattttcctgagatataactttttgacgcagtaatctttctcttacaatcttcgaa

SEQ ID NO: 2241 - DNA, 648 bp, Picornavirales sp.
  isolate D-16-0054, complete genome.1
aatcatcactcatcaaacgttaagtcccctgtttatacttctcgttatcattactaaattagaaactcatctttgcggtgatatataattgtcgtggttgtcgattatatattgtcgtgctgtaggatatttgtcttgattgttgagatattccaatcaagcgaccttctatctaagttgtcgagcatatgaatcgcatagtttattcttaattgataccgacttaccctcgccttcatgtctaaataagctatgtctcatatgtgacggattacagcactgttaacgttttgagacgatatataaggagacctaaaggggtcctcctggttttaaattgagtacatattgtaccgtaccaggcaaaggcctttaggagatctatatattgtttcgaaatgttgataagtaaatggtttctcaccccctccccgaaccttaacgtgattgcactcatacataagaatctcatgtcctatttgaatcatcaggattagactcttttgcatgtttaatgaactcggcgcttaaccacgtcgtttaatgaattagaacaacccaatattgtaggaaaaactttcggtgatataaagaaccgatgacaggtgtcaaagacactgaccgacggaaagacgtcacaacaaacta

SEQ ID NO: 2242 - DNA, 649 bp, Wuhan spider virus 2
  strain spider133995 hypothetical protein gene,1
gcggggttttccccgcatcgtcttttcaaccttatcgaatatctgtgccattgtgtcatggctatttgatattgtatgcttcttttgtgctcgttcggcaatgacctttccgcacgatcactttggcagctttcttttcaccttccggtttctttttgttttatgttagtttgttttgtgctgttttgctgtatgcgttctctacctatgtaacgccagctaaatgtttactataaaaatacttttcataagttagttttaaatgcattccggtttcggttttagaagtctttttgttgctatcttaattatgtatgctcctagtgaaggattcgctctgctagtttaaacttagtatgacatatttaattattttagtggcatttagcaactccattaatgaacgtttgtaattaggtgagatacgtaggtctcctgtaatgtcctttgcgtaagttgcttggttagtcccttgcttcttagacacttcgtgtggtggacctcttgcactgactgttgaggttgctcataaattacgaattagtaaggttggttttaggactttttatcagctttttggcccctttattataaaagctgtaggtaatggcctcatccatacgcctaacattgtttaatcaatgtgaaa

SEQ ID NO: 2243 - DNA, 650 bp, Robinvale bee virus 2
  isolate VN1-57 nonstructural polyprotein1
tacaaggcctatacagaccacctagatcagcggaacttaaagagaacgtataattatcaattattcaaacgctgatctaaatcaacttttaaacaattaaccctgacacgtccatcattgtaaaatataattcatattcacctttgcatgagcagttacgagtacgaagaaacgaagaagtttatagagcgagtttatgagaagtttaaaacgcacttgcgtcatcatccgttgtgcacttctcagttaccatcaattcgacagtgcctgacttgctcagagtacttcaccgcctatttggactatttggtacatattttgtcatctttaccaatatccagacgagaatacaagatccttcgtctcgtcgaaagcctacaattggaaattgcagatattgtagaggctggcggacttgctcctttcatgtttgtattttcttccccttctgttactcgtattgttggcgaagaccttcatgaagtttggtagatcacaatcattcattaatatatcattattcattgtatttaacctcattctcctgtatttatcaattagatatcgcaacgaacgtcgaaagaagctaaaacagaaggctgaggacattcttgaatcttcgcgcttgaatttgtttaaagacgatcacg

SEQ ID NO: 2244 - DNA, 650 bp, Wenzhou shrimp virus 10
  strain WZRBX43419 RNA-dependent RNA1
ccgatctcgcctctcggcttggactaacctggttatcactaaccagtaccgtgtacaagtgactccacatgtggagactcctgtcttcacccgttaagtggcctttaactacacgctttgacttgttctacgaacgaatcaggcctgtagttggggttgccatcctggagtagcattcttccttgtcttagcctgttcttgaacagaattagactaggaaggcattgctcccagatggcttcctcccgttcgctggagttctcattagaccccagcagacggataagcccacctaatagtggtcattcaccattgcattgtgcgtaagtgaatggttgtcagaagtgacgtgatcgtgtcctctctcgaaattgttcttgttcaagagagagctcatgctgtgactttacaaccaccggtgtcctatttaggacaggtaccggggggtgcagcccaccccaaaaccttaacaggataggactagtgcgattgggtaaccgcattatcctttaccaacggtaagggagtccgaaatacaactacctgctaacacgaaaacaaccccaggtattagggtcgttcccgtgtcgaggcgccgtactacttgtcctagcgaccgcaaggtcaatggaaagtcggacttgaaggct

SEQ ID NO: 2245 - DNA, 652 bp, Chinese softshell turtle picornavirus 2
  strain WHJYGF758571
cctgggttgatacccagtggtcatttggacgctttggtaaggaggcgtaattatccttcccatgtggaacctagtgcttaggttcttttatatgttctttgtttgtcctgtatactttctatcgggcaatcttgtagcctaacacaatatgtgttttgggttgcctaagataatttcaattttaaccagtccctatcttggggttgtgcctttctttctttcttatatcttcttaagctgacttacttgctaatccgactcctcgtcaacgggagggtaaagcagtatcactagggtattgtgatgtaggagaaaaagtaagtaggaattatacatgtaacgaaagtaatttggtactttaaactctcttaatcccaaagtgtggtattggtcatgttggagtaggctacgggtgaaactccttcacatttagtaatgtgttcacacgctaacgctacggtagaagacagactaggtcttattctcaacgtagggggacgggtgtatgttcatgactagccacatattaaggttttgaggggctgaattatataagtatgtgtattaattcttggtactagtccctggggactagcccttttctaggttgatattagttttccccaattttaaaacatatgagatttacgac

SEQ ID NO: 2246 - DNA, 652 bp, Sanxia sobemo-like virus 1
  strain SXSSP20269 hypothetical protein1
gggccacgtcggaaaaaggtaacaaacgctacgaagccatgtacgtcaatggtcaaaatgacgatcatggtgtagtgattaaaggcataagaggaagaatagtttatgctgaagaacaagaagactggatggacatctcaccaactccaaagaagaaggtgagatcgtttaccggagaatctctttcttcgaagaccacaactctcaccccgcagttcgaagaccaacctccttttttagaggaacgccaggcccagcaaaagctgagcctggaaacgctgactacagccactgccgaactcagtcagaaggacaagcagatccttctgaacgctctgatgatgaagactcagagctcggggccgagacagaatgctactgtcttggatacagcacaggaagaacctgcaccgagccaatctggctcgacgttccagccaccgagaacccaggaccgggttacgaggaaggcctctacgcgttaccacgcgtggactcctgcgcagaaaagaagagtttctgtacgcacgtccagatcaacgccaaatcgcacttaaatcacatcccccctactcaacacgaacaacaatatgtcgaagaaaacatcttaagacatctccgctcaatagctggtgtttactgctattccacc

SEQ ID NO: 2247 - DNA, 653 bp, Picornavirales sp.
  isolate wiw119pic1 genomic sequence.1
gatccacgaaattcaggattgtgctttggtcaggcaattctgaaggagagatctctgtatcctggtatgggatctcgttgacctgatgaggacggatataaagtgtttgcacctgtcacgtagtggggtcattgcagctattctattattgctctggctgccgcaaatgacctaggctcgtgtatgtgtttatgcattcacactctgagaatcaagacgtgctctgtaaccatcacaaattctcaccgtactatctcgacttgtcttgaatggacatgaaatggaacggaatggacatgaataagaaattcaattttggatatgcacgactggcgactgcgttgtactgtctttcctcttatagggctgacacagacgttgctttaaagcgtgaagaagtagtttccaattttgtcttaggaaaataatctcgagcgattcgcatcctgttagggaataggattgatgctccttttagttcttgtatactgatgactcttgtgaatggaatgattcagtaacgttagcatccgcttagccacgggtatcgattaaaactggctcccacactagtaacaaggccccatccatgttcaagagcatgtagttggatcgcctggtgtcagcgaacagtattcagtttttctgaatcg

SEQ ID NO: 2248 - DNA, 654 bp, Human respiratory syncytial virus B
  isolate HRSV/B/Bern/2019,1
actcaattatcaacattgaatgacaggttcacatatatcctcaactgcacactatatctaaacatcataaacatctacactacacacttcatcacacaaaccaatcccactcaaaatctaaaatcacttccagccattgtctgccagacctagagtgcgaataggtaaataaaacaagaatatggggtaaatagatatcagttagagttcaaccaatctcaacaaccatctataccgccaatccaatacatacattgcaaatcttaaaatgggaaacacatccatcacaatagaattcacaagcaaattttggccctattttacactaatacatatgatcttaactctaatctctttactaattataatcactattatgattgcaatactaaataagctaagtgaacataaaatattctgcaacaaaactcttgaacaaggacagatgtatcaaatcgacacatagtgttctcccattatgctgtatcaaatcacaatcctgtgtatataaataaacaaatccaatcttctcacagagtcatggcatcacaaaaccatgccaaccatcatggtagcatagagtagttattaaaaattaacataatgatgaattattagtatgggatcaaaaacaacattggggcaaatgcaaca

SEQ ID NO: 2249 - DNA, 654 bp, Menangle virus
  complete genome.2
caatcttgactggaaagtggataaaattctctctcagcagtctgttattacccaaatcaaacacgagcaacatgcaatcaaagcaggaatagccactttggaaggtcttatcaccaccatcaagatcatggaccctggagtaggtgatggcgccactgcggccaaatcaaagagattatttaaagaagcccctgtggttgtgagtggaccggtcattggagacaaccccattgttgatgctgacaccattcaactggacgagttggcccgcccatctcttcccaaaacaaaatctcagaagtccagcgctgcctcaccagcggccctatccggctataagatgacattattggctcttatcaaggaatgcattcccaatcaggcaaaacgccaaaagtttgaaatgcaagttggcggaatccgaaatgagcaagatttcaagaatctccgccgagagataatccgcagtgctgcccaataatcattttgtacgctactacatcctgccaattcagcacaatttgattaatcaccgcaattaattagcaactattaatctcttcttatgccaggctttgcttatctgcgactcttctttgagctttaagaaaaaataagtgagcccgaaccagttaagaagggcacactccgacc

SEQ ID NO: 2250 - DNA, 654 bp, Israel acute paralysis virus
  of bees from USA, complete genome.1
taaaattgtacgtagggacttttatgtccctacgtacaatttacgcagaaattagcgatataatttcaaaattgttttgtggcgcctgagcagcctttttaatggtaggagcgtcgatcccccgtatggagtggagaatataaggctcagctaggatgacacgcctgtacactgtcgacattagttaagttacaattacacgtcttttgccgaagaaaccattttagtcaattgattatgatttttgtataatgataaacagtgatgaactgtataactcatcgataacaaaacggattacgaacctatttgtaactatcttgatcgaagtctagtagatccccaatatagccctgaaaagcttgagggacgagatagctctataaatagacgtgaggctttaaatcctgataagtacattacctgagaattcctccttttggagtttgaatttatataagttagtaccaatagttaatatcatttaagtatgttattattgctgaagacatgtatttcggataataacctctacattgatatataaattatatgcaagtctcggtggatattgcattatggtcgcagttaacctgtagcttatatattcctgtgtcggagcagtggtaatggagccggataatttcgccaaaa

SEQ ID NO: 2251 - DNA, 654 bp, Wenzhou picorna-like virus 4
  strain WZSLuoI86003 hypothetical1
gtacgtctttagacgtacagtcagacttcttgtttagttgtgttcagttcatgttcaggtttactttatgagaagtgacctacatgtatttgacgcagttaaatgcgatatgacgatattttcgggtgaagaaaacacctcccattttgttgggtaaaaaattacattcttgtttttatggcctattggcactgtagcaggttcgagccctgcaaggccagtagatgaagaccaaaaagagtcattttgtataggactctgaatttatttacggtgaagttagatagaacgcttgcttctgaaacttatagagtacgaacatttgcgccagttatggcactcctttggagaactggtttatattgatgtgtgagacttgaggactcgatcaatatagcaaatatcacgtacataatattggaaaagatgagcaaggccagtaatctattctgatccctttgatttatttagggtgtataatttgatgctgacatttggtaacgggatttaatttaatgtactgctagtcccatagcgtgaataacgtttagcatatttattactagtatcttgggtcaacagccctgggtagcgcagtctacggagcgttaaaagtttgttacgaacaaccaattttggtgtagggggagcaca

SEQ ID NO: 2252 - DNA, 657 bp, Beihai rhabdo-like virus 4
  strain BHJP58499 putative nucleoprotein,1
gaatccctcataactcgataggctccgatttttaaagcgttgtttcctaagaggggtatgacgggtgagttacaaggacatgcctatggggtaacattttttggttttttggtttgtgtttgtatacgcttgcttatacaaaatacaaccaaaaaaacaaaaatgtcaccattagacacgatcttgtgactcactctgtcgtacccccattatcaaacagcgcgttaatgagcttaaaaaaacgaaaacacaactcaggaactttgcaaactcctaatcaccaatattcggttcttatcctaatataggttagacataatggcgaaaaatgtgacttttgttccaccagtgaggtccactgagacagaggatgagactcttgccactctctcagctatgagagatcagtggatcgcccaggacggtcttcccctttggagatctcaagcaggggtaagttagtcttcctagtgccatattatatcgatatgaggtcattaacattgctgaggtactaattcgtctcgtttatcctttcaggtaaaagtggcaagagagaaggggttgctcgcctacaactcgagtgccaagaagtaccagactgcaggagatctaggtcaggccaatgcctcgcagttcgcccaggccgctcacaag

SEQ ID NO: 2253 - DNA, 657 bp, Wenling banjofish picornavirus 1
  strain LXMC34076 polyprotein gene,1
ctcttccgatcttgggggttcgcccccatgtctcatttcaactagccgtgtgtctagttaacgcaccgcctcaccctggtcgttatcgggtcggttcttgcgaccgttagatcgtgagcgtttctgaggatcagttcgtataagttctccggtgtggcgaccgtaaaatcgtcacgtcccatgcaatagatgacgttaaactcgtttgccagttacataaaggaatgttgttacttttaaattgtctgttacatttaacatcttgccagtatgatgctactgtacactacgggtgtaggaaccttgtagtgtgacgtatcactcatatgtggatgggtgctccagacctttatggaagctctcagttagtagtgatccttgacttcattgagccctggtaacagtggaagtcaagatgtatatgttgctcaacacacttcggtgctacgaagctgtttgtggaagtactggcgaggttcattctgaatcatatgtttgtcacatagtcagggagtgccgtcgcttacgacggaccctttttctttataattacaaatctgtgtctcaagtgttgttggctggttttcttcttctgttttcattgttcatatatatacgtcagagtgaaagactcggtatatacaaaactgatccaga

SEQ ID NO: 2254 - DNA, 658 bp, Beihai picorna-like virus 2
  strain BHNXC40556 hypothetical protein2
agctgctccgccttgggcaggcgttgtatgcaccccgccttggacagcgtaaaggtccatttctgtccagggatgacgtaaaaagccccgcttgggacagcgaaacagtcctattccggacctatccgggatagcaaatgcatgagttgaaaataggtatgtacaacagattactgcatgtttaattatttatatgtttctttttcacatgttcagcattgtacatataggcacagccctcgcgctgtactggtattcaccagagagttagccactcaacaaaacatattgccacttggagtattaagcgaaacccttgtggtatgaacataaatagcttactgaaacaaacattaataataataattctaacaatccatcagttaatgatgggccttctttttctgtatctcagacgagtaatgagtcatcagcacaaaatgtacattttattgatggagactcgccatggacttatgaggtttcacacagcaccgattcgacatccaagcttacaggattcgatgacgcggacctcggatcattcttatctcgaccagttaagattaaagaatactcttggtcaccaactgttcagttgtttgaaacatttaacccttggactgagttttttaataatgcggatgttaaagataaa

SEQ ID NO: 2255 - DNA, 659 bp, Picornavirales sp.
  isolate H4_Bulk_47_scaffold_38 hypothetical2R
aggtcttaagtcctggaaggacattaaacttaacccgtcaggaaacttcttttcctgtttttccgtgttttacgttaaaaatatggagtcagtggaacttactcgcctcgaagatgtgatccgtaaatctctttcattctagtataaaatggagattctatcaggctatcattcgtgaaacggttgtgtttttacgcatagatcagtaaggcgccgtgctggcagccccagcaaagactaacgaaactagatatatcctaaagggcctgggtggaccgaatggacgaatataaccacctgctgaaaataatacaaatgcacagggacctgttgcccctattgcaaataataacaactaccctgtggcagttaccgctggtgaggatactcacactgcatctgccacaaccggtttcacaaccgatgctaacatcgcaaatgtagcaccacaagcacctgtaggagttgaccggctttttcttgcatcgagttcggacaattacgaacaggatatcaagaccttcttggccaaaccggttgcaatcaaatctggaaccatatcgacagccgatgttgttggtactcctttgtatgctgctaatttacctcatgatggtctctctgctagtaatatcttcttaaagaaaattgaaggtttt

SEQ ID NO: 2256 - DNA, 660 bp, Picornavirales N_OV_080
  putative non-structural protein1
gcattagcccgacttatagttggcactttgagcagtgcccgctttcgaaataattgtgaagattcaccctccatcttcgaccccatatctacgcatatggcgttattatgaagcaaataccatgtccctatttctagctcatgtgtattttcacttttattatctcatttgacttattctaacgcacattcttccattttcttagtgtgttatttaattatcaaatacaatacaaccccccctatttctacatggacatttatgtccattttgaccgattttttgggagggacaatttatgcttttatagatttatcatgggatagtggggtacaacccactactttatgttaatcaattctattttaatagtacctaaacctataattctggatacgcgttattatacgcaagttataaagcgtctatccctgtttagaaccatgtttctatccaaatacgatgacatccagaattgcatactcatgaaccccagttttaaattgaatttgacgatcccgtaaatatacttcagaatctgttcgtcctgattttatacttatgtagggtggtttcatgataaaaactataaaagaacgtccataaattgttttcccggaatttattctttttaaattttcctgaccatttttaaaccaa

SEQ ID NO: 2257 - DNA, 660 bp, Beihai picorna-like virus 17
  strain BHZY55665 hypothetical protein1
cctatacgtcgaaagacgtataggtagcattgtattatttgtgttgattagtttactggttatcacaaactagtatactgctgagacatatttagtaatttttaacgggtgatttatgagaacacctctccaaaaggagtaaaaaatctcattctttcaagctgtattcagctatcaaaaaacgttgtttcttcaattttcttcaaaaactgtttgatgaagttagttagattcactgatctgtgtatttacaaatccggtttaccgggaaatttggtacatttaagaccacaatacgacctaatgaattttaattgtaaagtaggcaaataattataagtcctatttttgatttgaattgtggaattaacgttttagggtgaatgaagtctgatgatatcgtgtagtgataaaagagccctgagaagctcgctaccagtcacagatgtatatatgtcgtgtcggacatagtcgagagacacataaggcactattcggttagttatagttaaagactacgctataattgaggaagatgaccggagtaccagctcatgcgagtaaaggtacgcaatttcaaatacgatcttcccgtatgttgattggcaagttaacatactatatatattttttgctgctacaaacaacaataatattaca

SEQ ID NO: 2258 - DNA, 662 bp, Beihai mantis shrimp virus 3
  strain BHXG26678 hypothetical protein1
ctgcattaatttgcagcatacatatttgacccagatgagttcggcctgggataacaatagtcgacaaaacttttaacccttttttattttcagggctgaccaccctctttcaaacggttagtgattgtctaataccacttgattattgggcaaagtctttttagcgtctgtttatgatttatttcattgtgctaaaacactttttgactctgtgcattcaggtatatcgtgcattgaactttcatccttgcattgatagaacggatttcatcagattcattgagtatttcttgatacagctcagtatagatttgcttgacgtggatatcagcccacgatactgatgtgattgattagacgtagtctgtcattcgagaatattaatactctttgtttccaggtgtcttcttagtaagcttgtctaactcagatatcttagtgtttgttccaaggaacgaatttgagcctacactcttgctaaccactggagtgtacaaactttgaggactcgacaccttcgaagggcttgtgttttaggccatgggacgtctccgaaccttataattccttgattagttgaatatgtagctcaaggtggattaggcgccacccaactatgatttgaacagttcaaatgagacattaggccgatcatatatact

SEQ ID NO: 2259 - DNA, 663 bp, Solenopsis invicta virus 2
  isolate Mississippi Delta, complete3
ccttttgatgtttgaattctaattccgttctcgccggagatgagtaccggcttgagtttaattcccaggtagcgcgagccgtgagtcagcccagacaagcgcagtagccctacttggagaggttctccttgagcgaccagaagctggcattgaatcgagccacataatgctgagagtagagggatttgcattctattgtgaaagcaataatttgagagctaagcccatcacattgtgcactcggaatattgtgcagcgcgaaaggttagtaacattaagttggcgaaaggttagcgcagcaatgattggtggtaacgctggatcttattgtggaagcaatggatgaatatgaagttgaaatcaggatcaccacacccccgcagcatagcggtaccgtactgaatgtcacaatccagtgatgatttgaagcctataacgggcggacgtgtttaaatggtgttttatgtggatgttagttcgccggaatgtgcagctccggatatcgagtcgaagattcagtgaccagtggagcaagcaacataggtaactatttcgtatgattttactcacaaaattgcactgggcaggagcttccaaaggaaccttctgcttctcgtaactgcacacaaactagatttcttattttcgaagagcatatttaaa

SEQ ID NO: 2260 - DNA, 663 bp, Picornavirales N_OV_011
  putative non-structural protein1
ctgcaagtcgtttagacttgtagagggaatgttagttaatagctgtgcacatgtcgtttagactgtgtattttctagtcaccttaattggtgcataataaaaatactgttttttgttattgtctgataggactttaaactatcaaacaaacctttcgtagatagggtcatttctctgaacttagatgagaaatgatatcaaactatttagtgaacgatggtaacgatgttgtgatacttatcacaacattttaatccatgtcgtctcttaattgagacggataactacgaaccgcactgtttaattatagtgtacgtgcactcgcacacttaccaaccattttagtattggttggctatattcttatgaatatattgtaatattgtagtataaattaaactttgagaccaagtgttgatatagttttaattttgtataattggaggccatagcaatgaggccgttgtatgctttgaacaaaatgtaaagcctagggcgaggaacttaatagttcggaccctggtatttggagtagaagatataaaccgccccgttcaaatgggtaaaccaatttttatgctgagcagaaggccgcctagcccgacctgcaagctactattcaattgacctttggaagctgagaagatagtcaatcaagaaaaa

SEQ ID NO: 2261 - DNA, 663 bp, Warroolaba Creek virus 1
  strain WRCV1 205652 hypothetical protein1
aatctcaatcttctattgagaattggtttttagattcattttacgagggttagtcaatgagattattacgaaggagtcctaattgtgtattctgtagcaggattgtacccatcccgctcatactaataaacggaacacgccttacgggaaatccgtattgaagtacgataaaggctgagcccggccttatcaacgtgagatctgagaagtgaagcacttgcaatgtggatcttcaagagtgattgttatttgcacgccagttcaatccagattacggtgcaaatgattcataaaagtatgagtacagatatctgcgcaaacaccctagtattcctaaccctcccctcttaaagcgtctacgggcgttgcaggtctaattgaaaacagcggtctgctatagagggagaattagacactaactcttttctttctcgcctcggagctttatagcgatgtgggaacgcgaacggtcactctctaactacttgttggttttgagagagacttagtacctagatacctaaggtgagaatgaacattgttatcaaaattataaaaactgccgaagcgctaacaacgtgaggctgttgttttctaaactttcttgacccataaatcgtatttagtcgtcactaatacgtagcaacgtttgcagcgtccctt

SEQ ID NO: 2262 - DNA, 664 bp, Alternaria alternata mitovirus 1
  isolate CREA-VE-3SY3, complete1
gatctctctcaccgaacctggccccgggcaaatgccctaatccagaggtgaatgtgtaaagtctcaggccaaatggggttggagaaggtatcaaagattagattaataaatgctttaaggcttttagttaaacttcttgcttgattccgtccctggtgtgcaaaagcacactacactcgagaagaataagagctagataaccttagggataaggggatctaactccgaaatacactctccaacacccgtgttctcctcctccttctccggcagctttgcggctgtcgagagggtaaggaacgagataggtgcggattgacacttccagtccagtataaaaactgaacaactgaagtctatctgacacatgtataatgttttctaatttagaaactcatcctaagtggaaattagcggcgaaaagtcagctatggggtaacccagatgctgtttcctaagctaaattcgactctccaatgttgaccttcttaacggacgacctcttaaatgtgaggaccctattaatctgactttgatcggattagaatgaagacaccaaagggtaaagagttggatacggggacagtgagacactgacctagtaccaaacgctctagcacctctggggtttaagggagtttaagcccttttaatagtagtaaaa

SEQ ID NO: 2263 - DNA, 664 bp, Lycopersicon esculentum picorna-like virus
  strain pt077-pic-41
accaaggcataatcacattggaatacggctctgagtcccttttgaacggttaagaactattcaactgggaaggcacccgctcccttgtggcgatgtccaaggatgacaaaacacaaaacccaactctatgtttttgtatacgtatgaaatcttggtgttgttaaatattagcagccaagtaacgtaagacagaataggttgagaaaaccagaaactaatcagtaggacctccgaaagttagaccttctggcactactctgaacttattaaacgggatctctagcatctaaattttagtcgctgacgtaagcatttgctagtaagatactgtgaacagttcatcccagatctatgacccgattgaaataagaccatcttatgaacgaataacggattatatgatttgacggatagtctcattgacatgcacatagcgagtttaatatgattgaagtagcaaaccctaggggaccgcaatgaatatcatattaaggttgaagcgcactcaacccttgtcacgagatagtaaggacgttttacatagtactatagttttctcaaaactgtgtataggtgcggataacattgaaaccgttcaccgacctcatgggatcgtcctaggaaagcccatgttgtatgataaactaggcctcaatgtagcaca

SEQ ID NO: 2264 - DNA, 665 bp, Wuhan sharpbelly picornavirus 2
  strain DSYC36136 polyprotein gene,1
tgcgggtaaactcccgcatgtgtgaatgaggcgatgtcccaggaactaactgccgatcctggttttaactacgatccgtatttgttactaatgcgatatccccccattgtttgcctccatgttgttttcaacgcttttggccttgagtgttatcaagtgttttagcgacatagtgggaagctacggctgcgtccccatttttgagtggcgacccagttttagtggccactctgtccctgaactgcgctataatgtgaatttatgttcacaaaaacggactgatgtaactgttaatgactaaggaatagtacctcactgaagtatcaagaccccgttcgagcggtgtacatatatggatggaaaccttgtctgagtcatctcgaatactaatcaatgagggatgtcgagtaagcatatcatgaaccacatagaatagtggggtttcggggttagaggctctctgcagcaatgtatctctaacaccatggccgaaatgagagatagagaccacgatgtttgtgtgtaagtaatgatgtgtggaaagaaaattctgaatgttggtatgatatcagtctaaggggagtggctcacctaagagctacccaaacatttcacagcagacaacataacgtactgagagtagttggaaggttccagaaatcagt

SEQ ID NO: 2265 - DNA, 665 bp, Beihai picorna-like virus 91
  strain BHJJX25930 hypothetical protein1
cttccgatcttgcgtaagcatgccctaagtatttgtggtggtctttaaaaagacatgattaatatgtaatatctccctttttaaggttttccctaatcagtcaccaccataatgccaaatgcatattacaaatggctttttcaacgttcgtgaaacgaattcacatccactattctagcgaatcaatgctcagctagtctagctcattgtgaatgttagcatcactgcagagcacatgtgatcatttctttgagcagagcggacccagtggcaatctgtctttgccggtttaaaattgtaccttaacaatccgcctatggtaacggcgtacccaggaccgcaaatccattaatgggataacatttcccatgttcttttgatattatgtgaacatgtaaatcttcaacaaaatatcacaatggctctatcaatctttcagcctcgacagttgaaagagggctctctagggatttatgtctatggcccctgtggttaaaacccgcccatccggaagtgtattgggactagcaaaggaagaatttattcaaatacctcctagttcttggatctgaccgggagttgatcccccgggtacactaaaagatgggacaggatctccactaccgcctgcatttaatagactgctttcccgactttgatatact

SEQ ID NO: 2266 - DNA, 665 bp, Changjiang picorna-like virus 9
  strain CJLX26226 hypothetical1
agtgttagtcacttgcatgaagagtagccgttgacagtatggcgatcatactggcgtattgggctttcacttgggtagcagtacctctgtgcctcgtctgtacgtctccctatctcgggagtctaaaaatagattcggtggttcgacagtttcgaccgagtgctgtgatggcacgctatctgaagtctgcggttgctgttggctgcaacagcgttgggcgcgataagtctaatatgtttgatgaatcacttttctttgttcgtatataaaaaacattaagttgctttttacccctatgtcttaggacagtaaaaattcatacacgcgccgtgtactaaagataggcgtattcatattctttcgttggcattttcgttaaatggccgacattcttcaaaataccaggtaagaaaccgcattgtgagctggaaattgcactgttacatttgaacctttttaggcgagctggattgctcatgtaactgttggaaacacacttcgcaaaaggtggatgatatggtataactggtcactattgaccgcaaggagcattatgtatagtgtgtgctctgtaggcagggaagtgctgctgtgttactatacacaagtcgtcctttggcgtggttgccattggatctgttataccacacacagttttaccactt

SEQ ID NO: 2267 - DNA, 666 bp, Hubei picorna-like virus 18
  strain QTM26408 hypothetical protein 11
cccggagccctgcgtacctacgcaggactttcttttaacgtcacctcgacgtgactgaggcatttacacaccctcttttgaggagcgccattaatttgacttgtaaatgaacacaaaaccggcccccaaaactcaatgacgacaatctttagaatttaacactacccgcttttaaagtaggctctgttatttctattgaggataccgcaaagtttatctttcaaaacaactcactacggaagataagtgaccacggacttcatacaataataaaaatccgtttaaaatgacgtgcacaagtaattatttagagactcttagtaggatatgccaagatgcgttctcgcatatccatagtattaggacaatctcacttaattaatcaccaatcttttaaacttgataataaaatttgtatgaatgatacattgaccctgcgaaataaccttttaaaatacgatttaataagataataaaaattgaattgggaactcaataataaaattcttatgtcggtgttggcgaaggaaatttcaaatctatgacaacgtgaacggaaatgaaacatcaggtttttcaactacccgcatttatgtaggctcttgaaaccaaaatcaacggttcttcggaaccaaaattttagaattaaggaaaacaaaaaccaca

SEQ ID NO: 2268 - DNA, 667 bp, Solemoviridae sp.
  isolate ybw116shi01 genomic sequence.1
agacagtatctgtatggtgtcggggtcgccagtagatttccaactgacggtctttcctctttcaaattgacctaacaaccattctggtgatgactccagacgttgcttaaaatgcacgtgaatcaagttctgaacatagttggctgagaaaccaccattgacagcaccgcccatttgatgaatcccaaggagttcattgcctttcatgtacgcagccccactataacctggcagagtcatctatacaggtagtactctgcaaggttatagtggggctgcgtacatgaaaggcaatgaactccttgggattcatcaaagcagccccactataaccttgtagagtactacctgtatagataactctgccaaagctaacagcatcgtgcgaaacatttccaacagttcccttcccatcgggtccaacaatttggcctgttgtccgaatctcatccatatgcccgacgttagaattgctcaatcccaatcgggagaactccgcttcgtccaggacaatggcaaccagatcagcatccaaagggatgcggacttttccagctaacgaaagccagacgcccaacttgctccttgcgcacttaaccaaacaagctttgggattttaattaattcaattgcgagttagaccatttattacttaacattcgtaaca

SEQ ID NO: 2269 - DNA, 667 bp, Western African lungfish picornavirus
  strain FZFYF1205461
tggtgttctcgctaggactcttggggtgcgaacccccttttcaacaaatattgttgaattgcaagtgatgtaacgtattgcactaattatagtaagtgttataccctccacaaaaatattttgtggagtgttaaggtatggattgtatagggcattagcaattaagtctgtaggccgaaccggcatgcacggtacatttgaatggactggagttatggtttgaacaacttagaagtcactgtgtgtattccttttaggttgcacattggcccattgatgaacgcaatgttagcgtagagtagtcataactattttgttcttgccatgttttcatatcttgaaaaatgtctcttgtttgttggcgtatggtttggtgctatcgtaaagcacaattccccagaagtcgtaagactattccgaaaggatttgggttagccctgggggaggtaggtctccatgactcagacattggatcatggcattgcaaaaacacccatgttgaggtggtgcccaatagatcatgaacaatctctgtttaagaatgcttctacatgggggtctatggcgctgcgaggaatatggtcatgtaacaagtagggttcctcttctacaaatgttgtagttggtgtttagattacaatctttaggaccataccggcagcgttaa

SEQ ID NO: 2270 - DNA, 669 bp, Wenling chelidoperca picornavirus
  strain LXMC188591 polyprotein1
gatctctgtgggggagttttattctcccccataggtcattttaaagcacccaacatgttatgtgcttaataaacttgcatgcgcgtggtctggcgggtggtttcaccctccggggtgtcatcatcaacgacccggtttctgtttatcgacaaaagcaggggcttggtggatgcctgattcaccacatacatcgaaacatgaagatgtaaaatttatgtcgttggtaaattacgttaaagttacaaccaccaccatcaggcaggattagattatccttctacgctcggtagacaaaaccttgtattcgggacaatctaatttggttatgaagtactgttgtgaaacagtgtgggaactgcttggttaggttaattcgttgtggagaatgcaccgtggcaacacgttttccccagcatgaaaggtagtgcatgccctagaccttagcctctcatagtacctgctgcgtagtggctttatggattaattgaattgctcctggagtctaaggagactggcgtaacttaatacgctaccccccttctttaacaggcacaattgtacaggatactcacgtgcagtcaaagaaaacccccggagagttagaaattttgcgagagacagtttttggtttactttgttgcgacgagtagcttgtaagaggccggcaac

SEQ ID NO: 2271 - DNA, 669 bp, Beihai picorna-like virus 31
  strain BHZC37445 hypothetical protein1
gtcccaccaggttttcacctggtggactcccctatattgtatgatttcattgcacagtttagcacctgtgccgtgcttttatacgaaaattttattctcctttatatacctttcacagtaattttgtgttctattatgtcaatacctctacgaggttttgcaagaaccctcgtatgttgtgttgtctttgaactcctggtgagtttagaaataacctcatcagattactacctattttatacataaagcatttattctcgttggtagagaactaccattcccgctcgtctgtaacgcgttaagtgcacaccttttggtgtatttgagctgattatattgaaactttatattcagatcgtctgttttaagtatgttactttattgtgcgtaagtcccttcaagaaaacttgcgtagtcgtgtgagactagagaactcagactaacgaactttcgattctgtcataattggaaatgatttatatgaacttgtttacaccgccccggttgtcttaagttagatactatctaggacccatgagtggttaaccccacatagatactagtattaaaatcggccggcgaaagccttgtggatttgcactccactccgagcctccgtccctccttcatcggagagggggttaaaactttttagcttctatttctttt

SEQ ID NO: 2272 - DNA, 670 bp, Saguaro cactus virus
  complete genome.1
gcggcgatatgaacactgccttaggaaattgcatcttagcctgccttatcaccaagcacatttgccgtgggttagacgcgagacttatcaacaatggtgacgattgtgttctcatatgcgaaactcgtgacgtggggcgtgtcgtggataagttaacgacagcgtggctccactttggttttacatgtatcgcagaggaaccagtctatgaaccagagaagattaggttttgtcagatggcccctgtatatgatggtgagaagtgggtgatggtgcgagatccgaaggtcagcctaagtaaggacgctttttctatggttcgttgggatacagtgaagaatgcacaacaatggtttaaagctgtggggcagtgcggtctatctatagccggaggggtgcctattgtgcaggagttctacaggatgtacgagcgcgcgggaggtcatgtcaaactcccagtgttgaaagaggttagcgctagtgggttgtttcatatgagtttcaattccaaccgggcctattctgagatttccgatgctgccagatttagcttttggaaagccttcgacatcttaccagatgttcaggaggccaccgaagctgaactgcgtcgcacctggattagtctcgattttggcccggctggtgaccttaacaaccctatcctaga

SEQ ID NO: 2273 - DNA, 671 bp, Beihai barnacle virus 9
  strain BHTH10927 putative glycoprotein,1
ctctgcggtccacttctgtcccacaaggggccgtgcctgcccagcgagtacctcgctctgttcaaactcgggaaaagaagagcattgtgaggttacttcctaagcaactattttcttttaagttagttctccttgctttttgcgtgtttagtgctttgtaggtatgtgtggtcccctatattggattatgtccattcgcgccctgtggcgccttccaggcagggaccctagtagaagtgatgcgtcctctcaggtatctctcttgtcgttagaacgtgtcgttagtgtggagcccggctccattgcccgtctccccgcagctccgcttgaactatacagtgatggtcgaattcgcccgccacaagccagtagcaatgatctctctgctgaggaattagatcggaggctagacctccttgcattagaatcaggatgatcgatcccagattgcccctcctcccgaatacgatatgttagtacggaggagaggactccacggcatttctgccaaacctggggtagcaaacatagggtacaaatacacgtgtcgttctgggtttctgatttaaaaccaccgatgatcgggattccaccgaaatcactgtttattagccgggccagaggtcttctgtgttctgagctcctgcttccggaactgctcgaaagcactg

SEQ ID NO: 2274 - DNA, 672 bp, Apple picorna-like virus 1
  isolate WA1 hypothetical protein, capsid1
atgtagcaatttgcaggtgcccgagacatggcgtgtatctgtattattgtttttatgtgaaagctcgccttgactaacccgatggctccttttaccgacggtaattatctttaagtaaggccggattagtacgtttcaagttgtggaatataaaaaacttctttaatttataaaagtggatgatgcaaaagttggattaagacaaagaactcttatacccaatgatcgcacgcaaagttagtatttatacgaaaggttagtgcgagtctgaaactcaacaaatgacagaagaaaattattttgtgatggatagcggaaagacggttctggaagaagagagaaaggttaaaagactagagcatgtatttgtttttgtggaaacaaatagatgagctagagaacaggttggtctatttaagcttagggccttacctttctaacgttacccgggagaatctgccaccattgtgctgggtggataacagtagtatctgagagtctaggcaaggaaaataggtattttcccctaaaacccttttccctttatgtaatacccatgtcatgttttaaaagagaagctttccttttgaaacacaagcacacaaatactaaataaatatattacttgtgaatttttatttctttttgatatctttaaatacaacgtttaat

SEQ ID NO: 2275 - DNA, 672 bp, Hubei picorna-like virus 53
  strain GCM3912 hypothetical protein1
caacgttaatgattccgtttgtatctttgatacataaatcgtttcgatataacgatttgactcagtcaatagacgtattgccttaaccggtttccgcgagtggtacttcgcgatacgtgcctcgtatcacattgctattgatttgcagggtatgaactttagtcaagagctgggattttcctgtgccccgatttcagtcttcacacaccaagacacagcgagtacatacaacgccttggtaggtcttaatagttgcagtagttttagcccatgaatttggctctgattctaccagtacctaaccttcgccatggctaatgtcactggattttcgctatcggggagccgcatcggagcgggccctacctaatatccaattggattgcaaaatgatcacaactaaccaaaaaaaaacaaatcatccaaacaaccaacctcacatccaccatttattcaccacaatctggcaaatacataaagaccaatatcacagattttaaaattgttcatgcaaattgtttttatgataatattaaattcactaatgtacctttgctttcagttcaagattcagaatattatttgtttacaccaactattctagccactaaatttcataatataacaaatggatcagttacagataattttgtcagaaaactcaccacatta

SEQ ID NO: 2276 - DNA, 672 bp, Cylindrotheca closterium RNA virus 02
  complete genome.1
cgggcattacccgtacatcacttattgaattatttggcattaaatatgcatagaaatcacaccctcgagtggcatctgagcattacgatgctcttatgtcactccgattgtgactctattaattctatttattctaggtttattcacacctccgtctctttcgagcgtgaaagttgaacccttgcctatgtatttgtgaaaatccagaacgaaggtaggtacacattgtagtgtatagtccttgtctaggttctcgttaggcacgagttcaccacctaggaataaaatctactggaatgccaccagtagttacgtagaaagttaaacgtatttattgacgtctattttaagatgttgaactagaacttggattctagtgttaggcgatttaatcgcttttgaaattgatttttcttagtgtatcatagcacagttagttaggttactccaatttcctactaaccccttttataggtaaaagataatgataaagtaattagagaaataacgtatgacacttcatatatatgtttacgtgttcgaccggcgcacatggtaagaccggaatcgagatcgtcaatgtatatgtgcttgtttgaaagcaatatgattaaaatttgacgtagggtatgagaaaacaccccgtccattcaattgtaataaaccacttct

SEQ ID NO: 2277 - DNA, 673 bp, Plasmopara viticola lesion associated botybirna 1
  isolate1
gcatgcctttgagatgcagttttgatttttgtacttaacaaaatgccatggatatgtatgatagctaatgactatctggaacaagaggcacgctgcccccggctaggggtccgaactgataaggttcttgcgattgatccggcgcaaggatttctcatttgagaaacagtcttgaattaacaagtttaaggacggaagcctcgacatgtccaatgttcacaatgaagctggtcttgtgaattcgccaaaatccagtgctttccctggaatcgtgtaccctctcattagagaggcgattggctggaacgggtgtaggtgtcagcaatgccctacgtgttgtccgtgcaaggaggagagctgcgtatccagcgtagtttgaatccgagtgtaacgactgcgaagcctttgtctgtagggtagtcctgtaaaagggggctatccgtccaggaacagtctgtttccctgtcctcccgtgaggtgttgttcgtgactacagttcaacagtaaaaaacagggcgatgtgtagatcggaaagatatctctaacaaagtattaagcgaaagctaaccgcgccgcctgccgaacgtgctgactagtacccgggcgtaaaactacaactacatatcacaaacctacgacttaactaaaacattccaaaatctacaaaacaaac

SEQ ID NO: 2278 - DNA, 673 bp, Picornavirales sp.
  isolate RtRrs-PicoV/YN2014 polyprotein gene,1
atatgtgccctcacctgtcaattgggaccaccactttcagtgaccccatgcgaagtgctgagagaaaggaagccttcttacccttcatttgtgaacccactagtctaagccgcttggaatacgatgagtggaaatgttcattctaaatggagtgaaacatgacttaacttttctagtcagacgcatacttgtgtgtctgagcgccactgtcttggcgtaattcttcagagtgtcacgccgtgcttgcggatcttacgtggcacatgacaaggctctcgctggaactgtgagtctgaagcatgtgaagtaacagtgaagagtgcatgatcacacgtatgtgtgggctatgagcctgcggatcaacaactggtaacagttgcctcaggggccgaaagccacggtgttaacagcaccctcatagtttgatctaccccagggtagtgatgttgtgtacctagtaattgccaattttcatgttttggtatcacggcataccggagagttcgcgggtgaaggatgcccagaaggtacccgtaggtaaccttaagagactatggatctgatctggggccctgtctggagtgctatacacacagctcagggttaaaaaacgtctagcccgccaggacccgagggattcgggttttcccttaaaaaaacccgactagagctt

SEQ ID NO: 2279 - DNA, 674 bp, Culex mononega like virus 2
  isolate OTU6 RNA-dependent RNA3
ttgtaaaagaaaaaggataaccggcactcctgttataaaaacccgatagtaacgctcaactcaaatcgctgaaccaatctcagagaggacaaggagtgagattttcctcaaggagagagcagaggagaaaaggtcaaggggaagaagaaagaaacaaggaacaaagagggtgaaaagagagagaaccagtggtaccaaaaatgacagattacgtcacatgcaccctctgtgggaccaaaatccctgtgattgttgtccccctcggcacactcgaaagagcggttcagtgtaacgtatgcgggcaaaactattcggtctctccaaagtgaactggtgtattgtagaagccaccttagacatgtacatatgtatacacatgtgtatgtgtctatatgcatacacacatctatatatatatatatatttttgatcaatttactcatttatttgtctatcatctttacaatctttcaaacagctcaagaagcatcagcgtatgtccatttggatacgcactacgccgggaagattgcatttttgtattgtgttttacaatgagtgttgcagctactttttggttggagtgttttcctggatcgggggttctttgttattaacacaccatccacctggtacttttcagatttagaaaaacccgatagttaccagtcaaa

SEQ ID NO: 2280 - DNA, 675 bp, Diabrotica virgifera virgifera virus 3
  isolate South Dakota,1
ccattacggccgggggaaaataagggctatggcgtcatgccatagtttatatacaccacggattacgtgaaccttgttagtaataacgggtgccctttgttagggatgtgttttatgaattattaattatgttataactcttattttcaactacgggattaaaaccccactttaaaactatatagggaaatttagtttaaacctgtataggaaattaaggattgataattttattgaacgagcctactcgttgaatatttatagttagttgtgataactagccttgtatttagacatggataatctccagcccatgttcgacataccttaggaagtttatatgcggcacgtattcaattaaatgaagatgctataagtgcttgattagacattaaaactagaacaagttctctagttgtcgctggtagagcataacttatagtaggtggattttatttgatgacccaagtatttatgaaatttgtcggcctccaagttgatcagctaattatttatattttgcgagtaatagtagttcagactgtgctatccccttgacatgcattttttggttactccagattgtgatattagggctctaatattgcaagactgcccaccaagtaaggaacttatgtaaacttgcttgggaaacacattactcaaaaaattatt

SEQ ID NO: 2281 - DNA, 675 bp, Beihai picorna-like virus 93
  strain BHBJDX18546 hypothetical1
gtggtttacacaccacgcacggtatatagttaaaagtcctcccaattgcaaccccggcttaacccgctcttttaagagttcgttacagcctcgcttgcatgacagctggttctatattctttatttttctttttgtttaaatgtgtacgtcttttgttagtgacgacgttaaaagtaactaactgagttttattagcgacctcattaaaagtaacttttatagtggatatctatctcttatcccgagtgaagattcgttaaatcactggacttgatttctttcattgtatgaagattcagatgcctatagtacgttcgaggtgtaaaaacctcttcgcggaaataggatatacatctgtttttgattactttgttagattgatagtgacggcttgtatcctactacacgtttgacgtgatatcgtataatcactaggtggcttgacaaccgcccaaatctcttgacctctcatgacgaagcataaacactaaactgacctcaccacagtagaattgtggccagggaactggttagtggtggatagaccttatgtcgaatccgcagtgttatcattgatgttttgagaattgtttaggtcggctagttgagaagctatagccctcccatgttgtcaacacattaggttctcaccttttacctcttttctctccttt

SEQ ID NO: 2282 - DNA, 676 bp, Iflaviridae sp.
  isolate rfb200ifl1 genomic sequence.1
ccccccacccgttcaaccaccgctaacatgtcggcccagtactacggcgctgtgtcgtcccctgttatgtgctccatcatcaattcggcctcgtactacggcgcgttgtcgtcttacccaagatgaggatattgttgacggaagggagaaaacccccgctgttttgaaaaccccaacttttatgtaaaatgtaatgtgttgtccacgttgtatgtttacgcggtggcatatataacaagaaccgcctgcagactaacactcacttcgtagatttgaggttaaagtttggaactgaacagttgatcattttctggtgtccccccagttggtttaagtactgtaaaaatgtgatatgtagtaagtgccagacctcttaacagttagttcttcggaatgttgattcaggtgacactgatgatcatttgtaggtatggacttggtatgtcgtaggggcctgtcaacgcaggtgcagccgcgcaaccccttgcagcaaaggactagatagtcgcaagattagatgtctgatgaatataccagacacagataatcgcttccaggtaaataactcactgtctcttcggagatataggacggtacctcggatagtcgcgcgccttaaccggtatctaggactcgttcgatcggagaacggcaagggctcccggattattttgca

SEQ ID NO: 2283 - DNA, 677 bp, Hubei odonate virus 10
  strain QTM133243 hypothetical protein 1,3
ttgatgaagttcaactactctttaaggtcatacaaaatatataatgtatcttatatataacaatatacacattatgatgtctcattaaacaattcgtacaaacagaatttcatgagaagacatgtaattgagtaatcatggttctttgttgtcaatgccaattggtatctgcttagtggccagaatctcgatatatattcatatcactcaacttgccatagtatccaattgattgtggtaacgtggtttgaagccatgtagaatgagaaactcattcttgagagatctctttgatttccattatatcaagtctctaattagttacatcaattcttttgagtctttaatttgttagaatcagttgatccttagcaagatcccatgcttcctacgagaatgagtaacttaacgttcgatatggaggagcaaacaatgaataaaaagacaagacttccacaggattatgcaaacatgagatgtttaccatcaattattttacccattgttagattccagtctttagaattatttttcaaattcttagcaactgaaaagtgatctataatataagtaattaaccaaaatacgatcaatcaatatctacactttatcactgtgtgttacattgttttagggctgtaagattcctaatgaaaagtagcagtttctgatgttgc

SEQ ID NO: 2284 - DNA, 678 bp, Picornavirales sp.
  isolate rfb094shi2 genomic sequence.2
tcgaccaagttggaggacacgttggaaagtacattgatggaaaaaataatttagaccttcaaaatttaaaggggagaaatttattagaccttcaaaatttaatcggtgatcagaaaaaagatgtcaccggtatggagatagctggaaataaagatttgcagaagaatcaacttgacaaccaggataagtggatcaatgcaggacgtgactcgttcactaaagcaggcctcccggaattttcattctgggatcggggtcgcggtggaccactcaatgtcggttcgacgagaagttcaatcggtggtaacaactttgtgaactcctttggaggcccaaacacaaacttaccgtcaaccggttcctcgccatacgcagacttgaatggattatcccgcccgttctgatcagggttgtcataaactttcttcatcatttcttgcattcttaagcgttttgtcatgagtcgcaggttgctgttactcatggggtactggtttgcgcacaacaaagtgttcttactggaaaagcgtttcattatgcacaaaaaaattagaattcctaaggagcttaactcccgtcattctagctatcgtgtaaactaaattagtttagtagtctttcttaaaaagataaattaaaatttaatttgggttaaacataacatcatacacatggatc

SEQ ID NO: 2285 - DNA, 678 bp, Picornavirales sp.
  isolate RtNn-PicoV/HuB2015-3 polyprotein gene,1
tgaaccgttacgcaccactcagttggtgtttggtggcaccaatgatggaacaaaaggctacaccacttgggctacggcccgcgccaccttgtggcgcaaagacattagaagaatagcataccgcccactagggccctgcagccagcagggtaacgggcaagcacttctgtctccccggtagaacggtataggctgtacccacggccgaaaactgaactatcgttacccgactccgtacttcgcaaagcttagtaggaaactggaaagttcgagttattgacccggagtgttccccccactccagaaacgcgtgatgagggttgccaccccgaccatggcgacatggtgggcatccctgcgctggcacgcggcctctaagaggataactcgctcctactggtaaccgaagagccccgtgagctacggtttattcctccgcctccctgaatgcggctaatcctaacccatgagcagttgccatagatccatatggtggactgtcgtaacgcgtaagttgtgggcggaaccgactactttgggatggcgtgtttccttgttttctccatttgttgttgtatggtgacaagttatagatctcgatctatagcgtttcttgagagatttccaaacatttattcaagtcgtacaattcttgtgtttaagcagtacagtgtaagg

SEQ ID NO: 2286 - DNA, 681 bp, Barns Ness breadcrumb sponge picorna-like virus 3
  isolate F53,1
acaataaaatttatgaattactacaattattatatgtttagaataagtgcttttgatggttcgctctagcaaagcgggtcacacgagggaggaacagattttggaatctcgtggcttattttattctcaagtatttatatagatgggatattatcgatgatttttggtgcagccgtaagcagcagagaggtaagaagtttaggcgaacataccattccgaaaggagcacaaaccgcacacaatggtttgtgaacagcaataatggtactttcactcgttttgcattatttgagtgtgctggcagggtcgaatctgtcacaattaggatgtcggcttaatgaaccgagtccctaattgcagatgcattactttagagtgaatagttttcaccgacgatacttaaactgtggtgactccacacccacctaatttctaaataaatatgagacaagtctcttatttgagcatttattttattgttggttgggggggcaaatccaatgatgaatcccaacacttctctcatatttattttccgaattagcaccaaatctctttattgattttatcaggagtatctcggactgcgttctatcgtcgtttgtccgggtgactgtcgtgaaagacgaatatttggagagaactccagtagctgattctgaatttttacaatattgccct

SEQ ID NO: 2287 - DNA, 682 bp, Fusarium poae mycovirus 2
  genomic RNA, complete genome.1
cacgggggcacacaacgatttaacgttgcatgatgtgatcttatcgtttcatcatgtatatatcgaaggatatataatgtaagttattttatgttatattgcttgagggggtatctcaggcacttgggtatgctttatgccgctatagcgttgtcccttaccgacacctatgttgtttataggtgcagtcagtcatgggaggaaatgcctatgccatcagacttagaacaagtcatttagaatgtcatcgtttcggccaaccacatacgaagtgggtggcggtccattcaggcaactggatgcggctagttacgtgtaactcgataccacaaagctcgcagcaacgaggccaggctttaacaattctagcagtccatgttagaaattgcgaaagataaagcaaggtgacccaagaccaagggtaagcaagggtcgacgtttacgttcgacgaccgcacaatctggggagtaagtgattgtatggccctgttcttgcagccagcaggaatatccatgtgtggcattgatacatgggaagcgtcaaaggactgtctagccatgccacagacaagtacatttgggtacttctagttaatcaagaaagcgattagtttcgcgaccaaaggtagaccgcctagatctagcctaaatgccgatgcacaagcggaggtaatctagcact

SEQ ID NO: 2288 - DNA, 682 bp, Forsythia suspensa picorna-like virus
  strain pt110-par-3-NW genomic1
acatattttcgcccggtgcagtgtcatagcaccagctggatttacttctgcaagtggacgcatttgcagccatatctccagccgtacctgagcttcctaatttctgcacgacccgtgtgattaggccacttacgtacaacccctcacccttctatttctttcacagctatttagtattacatccgtggcgttaggcccgcccaacatctaggcctctctatagcgtgtgagatctatttagaatttggttgagttattgtccctcaaccaccatccgtttgctactcacttgaccttgacagagcattctgttagtgcatagtagtcgattccatccagtaccccttgatcccgggtatctggcccgtagactgattgacttcagcttattgcgaagcctacccaccatagtaggagatagtagcgagaactgtcgatggtcagagcctgctaaagattattatgtacagtgatcaccaccttctggtattgtctacaccaacgtccattcggtcttaatcgagcctacagaacgcgccacgttctggtgctgaattggataaacaaacgtttagctatggtatagcttgtaattgtgacttcccgacgagggaccacatcgtttgctctggctatggtaaatagctaagccctagtaaggacttccacaggagcctccagc

SEQ ID NO: 2289 - DNA, 682 bp, Hubei odonate virus 4
  strain QTM161803 hypothetical protein gene,1
tgagggccttcagccctccagccgtattttgataatagcttagtttatataagactaatatatagaacagattaattcgaactatatatatgcaattaaattttgctattatcaaatgtggaagtatttcatctttatataagtctaacgtattttcaacagataaattcgagaatttacgtatgcatttgctttcacatttgtttttgatttcaaagtcattaaacaattatgtttgtttcattatcattttattaatgttaatttatatacttatacatctttcgtttaatttcttcgatttagctagctgacattcattatgaaacgcacataagatatattacgccggatacaggtaatatatagagaatcgtgtgctgcctgagtaaatatgtgtacttaagaatatcttgcgcctccatcgttagcgtgactaacgtatatatttggattgtataaagagcattagatttctttatgttttatgggcctcttttcaccttttggtcattagagtctacagcatatttatgtaggtatggcgttgttggcttcccagcttgacaagaaattatccacataaagacatataagtatttgttttcatttcccatattaatttaagtttatgggttttagctctcctagttttccctaatataactaggagatccgcaaa

SEQ ID NO: 2290 - DNA, 684 bp, Perth bee virus 3
  isolate WA2-20 polyprotein gene, complete cds.1
tggccatagtattgcgggttagcgtcccattaagattttaatatagctattcacaaccttaatttctttctttgattgaattaagccgctgtgtttccctttccgcacaaccactttgtcttcttttgttgatattgtgccgctgtgcccccttcttttcccctgctctttttatgacggtttagttagtaacaacttgaggaatagggattcaggctccagcccctggaatctatcgcactgttaccttgggagagaccactaccattaatatggtggcagaggtttcggtctcagtgttattcaaatacagttgttattagcggcgttcttttcggatgtctcttggtgatctcttacactagcaaagattgtaggaacgatgcctttggattgagctcttttgcatttacggattcacataagtcacatacctttaaatgtccctctaggcatgttaattagagggaaggtatgtatcagaatgtgtctatggtaccctgtatgtcaatggttagacatacacattagggatacggttatggcccaggaaacgttggtttgcctgggttatacataacacaaacgctcattgcgagcttcccttcttatgatttttctcctttggcgaatggaacgcgcgtcttcggaccgtaagtactaatagccaatcccacaattgaa

SEQ ID NO: 2291 - DNA, 685 bp, Blechomonas juanalfonzi Leishmaniavirus-like RNA virus 1
  strain1
tcccaagctctccttctctacggcgaaagggcggggtgacatcaatttcggatatcgcccgttgatgacttcacctctaaccctctggaatgcacttaaatggcgtagcctgacggtcccttctagccaaagggtgaaacggaagaaggctacagtttctgtgtctgcattgaagtgaccttgtgatctaacaccctgaatacttgttagttcaattgtcttatttctggctcaataggttcggctaacgcgggttgttcctaagcctatacatagtcgtggctgtcttgtcgatcgtaaacagtgacagcgtgactcatcgtgatcatttaaagtattttattgctggcagtaggttgttgctattaagtctgaattgttccgtttgctgtgctttcaacatttaagcttacccacttattgcttgtggtatttgtagtacgtattgtggattgtcaggtgagtttttggtgcgtgtgccttaacacagtcttagtgcagactacctcactgatcgtaaagtggttggtagtgtcactcgagctagtttagtatcactccttctattagtggttgctgtgtcagtttttgtgttttcataatatttaacttcagactacttcactgatcgtaaagtggtagtagtatccaagcccgttgggatctttaactttaaaccttaaca

SEQ ID NO: 2292 - DNA, 685 bp, Wenzhou picorna-like virus 8
  strain beimix75836 hypothetical1
cacgggaattcccgtgtgcagtgtaagttagattacttggcagtttttgccctaatagaccatagacgtcatcctgggcatattatgcccattgtgaccactacgtctattagtttttctaacacaaccaatgttttgttctaagtattgatcgtgctaaactagcgatccccattttctttgagttgagttatattattacttgactctttactctattttaagtagggtttttagttagcctgccagctagctatttgtttgtcactattgtgacacttgattcttcagattgaagatgtagaactatacctggtttctgagttcaggcgatttaatgttctaatttattgtgatttgtagtgaatacagcacactaatagaagttccgtcaatcttactattagttctccaatattattatttggagatatcagatcattttagatttttacaaataacgtacgaactctcgttagtgtatgtgtgtgtaggccggtaccgtatggataaatccgaaatcctgatcacatatgcactagcgcttgtagaacgctatatgaagcaatctgaagaatagggttaagcgagaaccccgttcatcaaatttcaagaccaccactcctgtatgaaaagaaagtttattagtatattatatcgtttcaagtggtgaaaaattgacaat

SEQ ID NO: 2293 - DNA, 686 bp, Chinese broad-headed pond turtle picornavirus 2
  strain WHWGGF755341
cgggattacccgtgcggcgcttttggacgctctagcttggaggcgtaatatccagctatcgtttgccgtgatttacggctattttaattaataaaattcaaaaacattgtgcccttcccccaatacgacctggatcttggtcgtggctttagactcaccatcagtgtatggtagtactttgcgatattatgtcgcaatggcccagattgtttgtcatactattgggccctctcttgtggcccaatcttttctttatgtttgtttcttagggtagtctgtgttaccaagccgagtgctcgcgtgtggcatgattagcactatcactagggtggtgtgagtaggcgaaacatacagagtggttgtcattctcatgtggtaatgttctgcatttcaacccttacaagtattaaggtggtgtatgtgtgtccgtagtaggctacgggtgaaactacggggctaacaatttagtcagcaatgtgaatagtggcggccaattgtgcaaatcaaattgataatcgttgctcaattcaacgcctgggaactacactaaagctgcatacttgccactggaggatttgttaaggggtggttcattatatcacatgaggattataccgccccttctacgggcgcttcagacacgtattagttttcccattataaaacaaatatgatatagaggttat

SEQ ID NO: 2294 - DNA, 687 bp, Hubei picorna-like virus 50
  strain spider113255 hypothetical1
gttttttattattgtttatatgtaattgtatttgtttatatgtattatgtgtagtgtttcgtggtaacattgttattgttacctgtaaaaatattaaaataacaatataagttggtatacttgttaactgaagttttgtagaatactgggttaatctggatttttgtatgaagcaattgccgagtaagatgtcgtcctatagcttatcaaaatgttcttcggaatagtttagtttcataaccttctgtaattcatatcactgagagaagcttttaaagactttcaaatacatgttacggggaaactttactgggtcgtgccgttgtttaagctagatagatatatcattggaccttacttggactgaacttttgtggattcttcttggtaggttagcaaccggttttattaattactacctttcgtttcgagaaatcctcctttggaccgccaaaggatcgtcgattctatgaactgagtgtacatacgttgagacgtttcgaaatgttctaattaatatgacatctgcattatggaagttttcaagtggttaatcccaagtttccatggttctgccgccgaataactgggggttctcatcccttaagtgatgacgctggaaagacagcggactgatggaaagacatcatttttcagatttaaagcttttatgactagtacaactta

SEQ ID NO: 2295 - DNA, 688 bp, Changjiang picorna-like virus 9
  strain CJLX26226 hypothetical2
acacaaatacgcacatcactaactcaaatagtgaagcacgggaaagtgtgatgtggacagggtgtcgcctttaaacctagcttttcagctttactactcaggcggagccagagaggtgcttctattgcagtgcgtgggaccgcactgcaatgtaattagtcccgctagttctacagcgaataccgatcagttggatcgagactcagtcactgtttgtgatcaagtggattctcttgccattaataatggacccgagaccactggtgtcaccgagtttgtacaggaggcttgctctcagattgacgtgctaggtgcacatcacgtgcccgcgccgttatctggtcagagccagtttcaggacttgaaggcctatttctcccgaccacgtctcgttactaatggtaacgtcacaagtgtggggaggattgcggccatcaatgtcacgccgggcatcctgttggctacgctttttcccgatggggttaagcggttgacaggtgtgtatggcatccgtttcactttggtgtttacgctgcaggttgcggctacaccattccaccaaggtttgttagcattgaactggcagtatgaggttagttctaacactaacgaagcttatgtgcgcagtgtcaatagtgagactgccaccaatcttccccatgttagacttgacctcagtgtggacacg

SEQ ID NO: 2296 - DNA, 688 bp, Wenzhou channeled applesnail virus 3
  strain BHBei77067 hypothetical1
gctcttccgatctccctggagaggtgtaattgtatctcttcagagtattttttggtgcgtgttcccgtagggtagtatactgtgaggttgctattcgtaggggcatgttaagaataatatatatattatcatgaggagttgtttaagccgtgtgttatcgggcttctttgaagtagtatattttctttgatttgatatgttacattttgaaagcgatcttttcgaatagtgatgtgcaaatatacagcaacgataatttacacctattttaattcttgtacgaagattttatcttcaattaagatggagtcagttaaacccaacagcctctaaagtttgaggaaaaagaacaaacgttggtgactgtgtcccatataattgtatttgattaatttaggaataatttggattgctagccttgtctgtggtacgttattggttttagcagcggccatgcagttttgaaaacacagatagtctaggcatctattagctgtagaatcttttgattcgagttgtattggcaatttttggttgacagccccctatcgtcctgggtaattgttcaatatgacgtgcaagtgtatgcaaagagccgattctatataagctcagctatgttaccccaagttgtacgcgatggtatcaaatccttgggagtaaaggaacagagagatagacttagttc

SEQ ID NO: 2297 - DNA, 690 bp, Astroviridae sp.
  isolate coa196ast2nc genomic sequence.1
atcaaggtatacccttgatgaggagggttgatagtgtaccagactatattgaggcttatttgagagcccatgctgctgttgaagtgcgtctgcgtgacgctcttaaggaagtatctcacctgaaaatgcagctgatgattgctgataggaagaaagatcgggctgagaggaaagtagcaaatcttgaaacctggcgcagaataagaaatgctactttcctctcagcccgatctttcttcctatcagcaatcatcagctgcattttcaggtgagatacttccttaagagcgtcacgcagacgcacttcaacagcagcatgggctctcaaataagcctcaatatagtctggtacactatcaaccctcctcatcaagggtataccttgagagacaatcctgacttgaaaaaactcctcacctttcatggcataagccactgtgaggttctggagaaaaaccttgtcagttctcagcaattctttccagacattagtagtgccaatagcactcctccaaagagtaaagagattctgggttgctacgccagatatgacctttgaaaggccagctggtgtggaacgatccatctcctcttacgctttggaggagtgctattggcactactaatgtctggaaagaattgctgagaactgacaaggtttttctccagaacctcacagtggcttatgcc

SEQ ID NO: 2298 - DNA, 691 bp, Dicistroviridae sp.
  isolate sru103dic1 genomic sequence.1
tagatacacgtcctacttatgtggctactcgtggtgcaggttgtttatcctgcaccacgagtagccacataagtaggacgtgtatctacggcactgacggactaattatgtgttgaggatatcgacggatagatttatgaaataatatatttctgacggcgatattgtcatacgaaatcccccataggcgttatctacggcactggcgaatatggactaaaaatgtttaccaaactgatcacttagagatccccaaccacacataaatacacttataaacgattgataacactataacaatttgtaggcaatattttattagaatttaagcataatgatgttagtaacctcatagtaacctagatatatttgtttgacaaatatcccacagttgagtgaaatcaacaatgggccgtttaggcaatgttatgagaactgaggcgttaaattttgacaaatacaatacctgacaagtcccttttggattgactaaatataagaatagtatcaatagtttttgaatttaaataagttattgtagatgaagacatgtatttcttgcaataacctctgtatttcttaaactatatgcaattactcggtggtacttgcatcttgatcgaagttaacctttattcttatattgctgtgtcggagcagtggtattggcgccggactaattaacataaac

SEQ ID NO: 2299 - DNA, 691 bp, Beihai picorna-like virus 11
  strain BHZY60905 hypothetical protein1
tccctagggatgtatgaaaattatccttagggcttcaagccaaatcgaattggatgattatcgtcatcctctttgctttgtttaaagctataaaattctacgttaaaacatttgattctcatttttaaacgttttgagtttctacacactttattttactgccgtgcacagtataaaagcatgtttcagaccttagtaatgtggtctgtgtaatttacgacattgcatatcgtttcggatcaagtacgttaaatctctgttatgctaggtaccagagacaatatttgatcctttcttaaatcttaacatacgctagaatgttagatttgagttctaaatacaatagttttcagtgcggaacggaatccccctgaatgttatatcacgtccagaatagataaacccagcagtatggaagagtatcttagacctctgattataacagacagaacaattggtccaccccgagctgtattaacgcaacgtaccgcggctatgattgttacaataccgaatttatattccacgtttaggcattttaccaggatgtcaaggtagctgactgcacctaacttttttcgtggaccctatgttttcgtgaggtagaatctcatttttgacacatattttagactatttatagagatagtagataaacccttgacttagcacccaacgcttgttcctaatt

SEQ ID NO: 2300 - DNA, 692 bp, Picornavirales sp.
  isolate RtNn-PicoV/HuB2015-1 polyprotein gene,1
tttgaaaggggctgggggatgtatccccatcccccagtgtgtatgccatactgcatagctcgcctatgccctatggattcacaaccctttcatataccctccctacccaaccccgtaaccacatgctttactccgcttggggttttgcggccccatgttgtgacgaaatggctacgcaatcaatgcggctaatggggcctgccgcttttaagtggccccagttagaagtttatgcacacccgcccattaggaggccaccagccaggtggtcagagggcaagcacttctgtttccccggtgaagtttgataagctgtgcccacggctgaagcagacagatccgttacccgcctcactactacgagacggctagtagtgtgtaatatccgaatttcattgatccgggtgttccccccacccagaaacgtgtgatgaggagcggcacccctcctatggcaacatagggcctctcctgcgctggcacacgggctctatgagcatgaaatcaggagaaagtcacacgaagaccttattgtgctagtgttgattcctccgcccccctgaatgcggctaatcccaactccggagcgcccgctggcaaacccgccagaagagcgtcgtaatgcgtaagtctggagcggaaccgactactttgggtgtggcgtgtttcctttatttcctttgtatttgtat

SEQ ID NO: 2301 - DNA, 692 bp, Wenzhou channeled applesnail virus 2
  strain WZFSL85846 hypothetical1
ggtgtagggcctaaaaaccctacacctaattttatcatcatgtcgttgttatttatggacgcctgttgagagaagtattttatacgatggactcccgttgcgagaagataacccatgattttgtttcagatgtttggtttttagaccatacatttaattattttatgtgttttgtttttaatatgtgaaaagccccttagtattaaattgcaattaacaacataattcggcctttgggcttcttttatataaaataaataaaaatactcgttaccgaacggggtctttaaatagattgacaaactattttaagatgtataaaatcctactaacattgtgtagatacacgtacctattcgagagttgaagcagtgctattagatatgcagataaaagtgagggttgcgagctaataactcgtcctcatggccaaaagcatgcctctatcttttagcaatactgtgtatagtacttcagtataatgtgggcaagtgtattctgtcaaaacggtttaaacatatttgttccgtaacacaacaaatacaatttatgacgttggaaagcgttagtttccgagtttttctggaagcaagtttacttacaatcataaactgctaccattcaaaaatttttatttcatttatggtcacaatttaagattttagaaaagcgttcatatatttacatacaaa

SEQ ID NO: 2302 - DNA, 692 bp, Hubei virga-like virus 7
  strain QTM27262 hypothetical protein1
aggctggatcaattaattaacaataatggttgctgctatgaaaactgctaacacaactagacgtatcgtacgtcgtactattcccgtcggtaaacctcgcagttcaccgactcgacccacggtacctgtcgttaatagtgttaaaaaacgagcgaccgaaccaattattccagtcacctcacttagttttagttcgttaaattcatatttttcatatgcttcaggtgttttgttaaacaccgaatttttattatattttattgtggctatgtttgctatttttaactatcattcaatgcctgaaaattcctacgttactaaaattgttagtaatatcttttctaaggccagtgcttatgataagtgtacgtataccacgtttattatggcttttataccatttattcctgtcattttaagcgtttctagtaatatgcgtattttatcggctattttatgcttcgcattttataaatttttccctgaaaaaacttattatgaatatttagtttttgctacgtgcatttatttagctgtaaaaacgaagaataaagtatatagatttatttctattatcttattagcatttttgtattttatacaatttgctttaccattccctacggacaatacacttacgtgtagagctcctgcatcgaaaccaaattagaatgtaagataatagttaagtt

SEQ ID NO: 2303 - DNA, 693 bp, Riboviria sp.
  isolate rob114pic1 genomic sequence.1
tttaacggtccgacagaccgatatgtatcgcagctcttttacaaactggaaaactgctcttttgcatactaggatgaaactgtggatcacgtttgtcaaggttacggccccatacactcctgatttccgagcctcttatgcagaatcaagtcccttttgtagaacctgacgtacaatgtcaaccccaaaacccaaactttttgtttttgttttgtcctctttataaagaagattgttgtggcttataaaccgcaggttttcttttagatgacagaatacgctgagaaaacatagacttttggtagtaggacctccgaaccctttatgtttatgcactactctgaataacgtattaatattttgttaatcatctaacacactgatctcgtgtagatccttgcgcatttggttagtaaattattgatacctattcaccccataagcgtatgccccgaatgaatttagaccagaattttaacgactattggaatatatgaattgacggataccagataatgattattgtcagcgagaccttgtagcagaacgcgactgctaatatgaatctggagtacggatgtttttatgactcaaacagttttctcaaaactgagagtaggatggatttccgacctcggcaggtaaagcttctaggcctgaccgttgcatcactgaagcagccaatgtatcaca

SEQ ID NO: 2304 - DNA, 695 bp, Changjiang crawfish virus 2
  strain CJLX30764 hypothetical protein 11
ctcccggtaaatatatatacacagttaatagaactaactgtgtattatgtttgcctggaacgagggcagtatcccaagtagtgtggtaaccatttagcggtcccagcccacgctgtctcgtggtagaaaatgggtaactttttagggaagggtaaatccatccggtcatataattcacgcctttcaatgacatttgccaggtcacgctgattacagaagaccggtttaagaatagtttattgaggacatccatcattcaatgttcagtactataacctctcctctgaagacagagcgaaagttatggattgtttattgtatagtaaagttttgcgtgagtttgcatgcaaagcgtccccgtattattattcacaatcccagtggagggattgttagtcatcacttccacccatgcgattcgtgtgtggaaggtccaggagagtgcatcgtagacagctggtggcaatatacgtaagaccaccatgtcgcacgctgtagtggcgtgatcatccttagttaattgatgctttcatcttaacttccggtatgggccacttaccgttcatccattcataggtttcccgatataacatagtttgaacgccttttcaacacgatctactagcatcttcagtgggtaacaccctggagggaaaactagagaagccgttaacaattgaaaagattagtagact

SEQ ID NO: 2305 - DNA, 696 bp, Hubei picorna-like virus 51
  strain QTM27291 hypothetical protein 12
atatttaaacgaaacgtaattaatgcgacaaacattagttaaaacgttgaaattctttcctttgtcactcgtcattgaaccccttaattctttgttattacttttaaatcatcatttcacccctctaaattttcaggttgaacgcgtttaggtaagtctggacaaccgattatgtgagacgtaactgccctcatgtaatttgtgcttgtcttcggcccctatcctgcaactacctttatcttattatcaaagtctttagtcaattcctgcgtacacctccaaagggtgccttagtgcagacgagatctgtttacgttcgagaacaaccatgtacttgggattttccgcctaataacgtaacaagagatcgctaaagatagagaaataaggtataaatgagatagtaataatatatgaaattaagcttagtaaatggataccgcgagatgcctatatctataaataggagaagcttagtggaaaacggcttataatagttttctgacaccccaatagaattggtgttaaaataattctatacactttttggatatagtgttaaaacaatcctctcattccacactgaaagtggaattcaaatactttcagacactgtttttataatttcgtgtaaaacaaaaattataacactttgtgaagtagtgttaaaataattctcaaaaacccaatgacaaa

SEQ ID NO: 2306 - DNA, 698 bp, Changjiang tombus-like virus 1
  strain CJLX26263 hypothetical1
cgccaatatttcgtcgcctgtcttgcgttaagatgatgcttcagttgttggtctgcttgagtgtcgttggtctaactgcttggctgtgtgattatttgtttcaggtttatgatggggtacgcaggtggattcgggtacgacgtcgtgtcgccaatgttgtccgtaaggtcaacaatgacgttctcgaggttatagctaccgtggaagctgacattgcggctgatatcgatgcgtctactgctagtgctgtagatgatgaggtaattgaccgcactgtagttaaaaagcggaaggttaacaataaacaccgcgcatcccatttccgttcgtggttggttcgtatggcaaaagcaaaattcggacgggtccatgagactgaggctaacagactttgtgttcggaaatatttgtatgatctttgtgttgagcacggcgtggttgtgcgtcatatagcagagaatatagatttcgcgaccgcattagtttttgtcccaatgtcttatgagattgaagctctggcagttaaacacaccactgaggtgatggatcttaaagcgattgctgagcggttgcagccgctcggtcgatgtgcttgatggggccccgagaaaagggaggggatagacactaagccttctgtttatcccggcatcactcccaaattttcggggaaggcccgtccacgcaaatatctgact

SEQ ID NO: 2307 - DNA, 699 bp, Picornavirales sp.
  isolate H4_Bulk_Litter_22_scaffold_61
gttttgtgggttatcccccactttatgaatgtcactgattttgtattttatgatttcatagattagaatatcttgtacagacactcatatttatttatctacttcccgcgttctgcggttgctcttaaataaattaaattgagcagttttatatattgatatgatgaattgttaggttccccatgtggaataaacaagaatttgtattctaaagatttagtatttcgaaagattgaagcgtcctaatattttaaagtgctcgctattacacaagcgttgttatggtgtaaatagtaaacggtatagttgatgtagcccggtttgcagccgccctataatttgctatatgtcagacaaacgcgatcgtattgtataacctcctttgatgatattaacgattgaacatttcgtatgaagctggacttaccaccagaacttggatttcagaatgattaacgactttcggcttttgctgggagttgctccaaggaagagttcttccgatttgaacatgcccgagaataaatcattggcgttgtgcattatttggcgattctaataacggtttactgaacgatgtaggaatttagttgttgtaatgttgaacgtattattcacttacacctatttctgggcatcctttatggaaaacggagtcaatacccgacttgtattagaacaggggaggcacttgctaat

SEQ ID NO: 2308 - DNA, 699 bp, Robinvale bee virus 7
  isolate VN1-35 nonstructural polyprotein1
tgtggttaacaccacatgcttgatttgtttggccggaagccagacttgatttcaatttgcgttcattcgcacctggatgccatttgatgacaataacttgcgtgcgtttacgggcgtacgtatagacattaacatcgaaacatcttgtggctcataaccacactgaaattcaattctaacctgacaagatgaaagtatctatccccccctttttgttttgtatatgtacctgatggggcgatgtagccccatttatatttcattgatcgaggaataaataccaaaatatcatcactcgacaaaaaaggagtttggtcactgcccctttagtttcaatccgttctggtaataaactattgataatactccacaaagaaaatacaagaaaaagaaaagtgttttgagaagatgctagtaatttacccttgattaagatcattagtgtgtggtgttaagcacccactagataagcagagtcattctctgtaatcgttttgaacccttcgtcatcgattttgactagtaaaactatcaattcaggtcgtaaactcgactaggtctgtaccgccattccgaagaatatggcgggtatgccccacaacagagggatgaacaaaatatctaaccacaaaccagacacaacctacgatagactcaccaaacgcgcacacaacgatttgccccatatcagcacatatc

SEQ ID NO: 2309 - DNA, 701 bp, Beihai picorna-like virus 19
  strain BHJJX24523 hypothetical protein1
ttcacggacattcttttattcttcgctgcttgtgagaaaggagcagcaagtcttatggttacttctcatttgtcaatggctaaatgccatgagtgtcatttgtataagtagaaactttatatttatatgtttataagagaacgattacccaggtttgcaaaagctatcaaaccccctctcgttgggagagggtcttcagttaagcgatttctatgaatttgcgatcgtcctgaagaggaagtgaccttcaataacatttgtcagtgtaaaagtaaacatctttttagtgcgtgtgcgttcacaacgtatgggcaagtagaccttgcgttttgacagcaaccttattgtggattgcctactagattacatatgtttacctattgaaatgcctctttggaatatacgagaccattggattacaatgagtttctctgaatgagtgcggaggatggaagagtgagtattgaactacaatgtacgaaatcatggtactataggatttccgatcagtcaatatgtcactaatggacctgctgaacacagggtataaaatgttctgagtggtgtaaagctgcaaccacgaaaaaccatgtcgggtttgtactaaaacagcagtagtaggaaagcactgaccggtgcagttcccccggagggtaacaccccggagacacctcgagtaatgtcgagagtgtgccgacctt

SEQ ID NO: 2310 - DNA, 704 bp, Miniopterus picornavirus 2
  strain Henan-Ms56-2 polyprotein gene,1
tggcccttcccttcccctttcatgattcccttggatttgactcggattgtttgactacccttcttcttaccacattggccctagcggccaccggactgacctactcccatggcaagctgaacgccttcgcagcggaggtcccttcttcggatacggttgaccactgcataagtcgcgggcccaagtgagcttttggactgacccattttgttttctggactgccaccgccaagaattgcggagcagctctgtgtagagagatccttcctttaggccgaccccgtgtcccagcacggtagtaggactattggagtgctttgcacatctgcgcctagtgtcagatgagccagtggtgtcacaggaaaacgggacgcgattcgctatccctaagcatccctcttcggaggtaaagcgcctgtggcatacggtgggatcgtgccttcactcgagggccgggaaacccaccctggactggtgcagcttgacagagtgtcggccggcactctggcactagtagccggttgttctgggatatgctgttctcttacctctcctccttcaaatcctcctctcataccttcccccaggctttttcaaaagccccctcccacagagtcctctcttggattctctctcaaggagcccctcaccaccgtggctcctacctgcatgcaaccctgccctataacatttatgagcaggac

SEQ ID NO: 2311 - DNA, 705 bp, Rhizoctonia solani mitovirus 15
  isolate K-IL-s02-3-25b1
gtaacaacggaaaacgaactcaaaatcttgagttcagctcttgtgagcactaatttggtatttatactaggttacgcttatgggagttcccacaagtaaagtagcgtcgacgattacactgttgacgggacccgtctctggcgttgagagggcccgggggcaacctcgggggaaaccgaagtcactttctcttgaatgagaatgatagaggcatttcaacatccagaacgtaagtccgatggcaagcgccatcagtcctacgaaatgctgcggccccctgctttgcaggggaaaccgaagtttaattttaaacttaccgtataaaacggtagtttgtacgtttgtcaagttgaaattaagtaggatcaatatatatctcctagaacttgatatttatgttcccgcaagtatggcgcttagtttcctttgtaggaaagtaattcctattcccagaccatttggtcttcgaggttataggttatccgtagggactaagttaaagtcataccaggggtatcaagatggagttttaataaaaggctgagacgccgcttcccgtgagggatgacgcatcaggaatgcccgtgagtagaccccggaccggtgtaatacggtaccgtagtggctgaaagagccatatctacgaatctcctctcgaaagaggggagaaacggaaactatctgagtgctccttatatatataac

SEQ ID NO: 2312 - DNA, 705 bp, Potato virus M
  isolate PVM-352, complete genome.1
ttagtgtagcttaggtattgctattgtattgaatatttatggatgtgattgtagatttgttgtataaatacaagtttgagcgtttaagtaataagttagtgtgccctatagtcgttcactgtgtgcctggggctggcaagagtagcttaattcgcgagttgttagaattagatagtcgcttctgtgcatacacagctggtgtagaggaccagccaaggttgagcgggaattggatcaggaagtagagcgggcaacaaccggaaggcaaatttgtggttctggacgagtacactctgttgactgaagtgcccccggtatttgcattgttcggtgaccccatacaatcgaacacaagcgccgttcagcgtgctgactttgtgtgctcagtgagtagaagattcggcagtgccacgtgcgggctgttgcgagagttgggctggaacgttcgaagtgaaaaggctgacctggtgcaagtatctgacatatacacaaaagaacccctgggcaaagttgtgttcttcgaggaggaagtgggttgcttgctgagatcacacggggtggaagcattgagcttgcaggaaataacaggccaaactttcgaggtggtaacgttcgtgacttcagagaattctccagtgatcaatcgagcggctgcctatcagtgcatgacaaggcatcgaacggctctgcacatcttgtgtcctg

SEQ ID NO: 2313 - DNA, 705 bp, Beihai shrimp virus 3
  strain BHBJDX18821 hypothetical protein1
aggggcgagcagatccattctgtggatctgcaccccaatatactctcttcaggtcatctgactcatgtcacaaagtcagagctgacctgggagggtgatcagctggtcgacagcgaggggcgcaaatcacaacagctaacaatacacacaagaacaacaacagacacaagcggtgaggtgacaattaaacaggaagatgcaggatttgaagacgtgagtgtgctccaagcggtagcgaccacgctggacaacaatggtgacgatgggagcgatgacatcatcagcattgaagaagccagtcccagcagtgacactgaggacaggccagtagaaccacaggctgaggaagaggaagatcaggatgtggtcgttggagttgaagaagaggaagagcctgtggcagaagactgggcagcagaggtagaggcagctgaagaagaagaactaatagagctggcagtcgaggcagaaagtggccttgccagtaagacagtattcaacacagagggcatcaagaaagttgacaaactcactgtgttgaacactgtctccacattctaccacctcaacagagacggccacacatacccagcagcacaagtgacatttagctttaaggatttcagcagatttcctgacaagaactacactgaggtgaaggctaagggcttgcctacattgacagtggctgtgcttccagcagaa

SEQ ID NO: 2314 - DNA, 706 bp, Bat iflavirus
  clone Bat/CAM/IfaV-P17/2013 polyprotein gene,1
ggaccgtactttgtcgacgttttgaacgatgacgaatcggtatacgcttcggtacctattgttgcaagttcgttccctattttcgatttgcctgcccgaatttgactcaaacaattgtgacatactatgtctctgtttgaaagcactacacgagtttgcgcccagcatgtatgttttcaagtcttttgtataagtctgcctctatagtggttttctttgaccttaaagccttgtcaaccatcctatatgctgcatcgagacttgatgtcaatctgcctctactacgcaaatgtctagtaattagttataaggttttactattttccctcatttccaattttagtttgtagtgtatgtgagtatcattcttactccgactgttaagagaaaccaatttatagtcgttaaatatgataaatggaatgaatgatggtgtcattttaaaaacactcttctctataggcgtaagcattctcgctcttagagtcgtaaagaagaaatgccgtgtctatcagtatgttatgcgatttattttctgccacgcgcttctagtgcaatctagttgacatacagacattgcctaccactcgcgagggtcgaccggtagtgtaaggagtaagtgatgatttccgcttattctgtaccctttgcctggtgaggacagatcctgactaattttaaatataaatgaacactagcttccaag

SEQ ID NO: 2315 - DNA, 706 bp, Shahe heteroptera virus 4
  strain SHWC01c2975 hypothetical protein 11
atgcatgtatatttttattcatatgtagcattatagaatgtaacacatatgcttatgaatcgagtaaaatcggtcacggcgtcactgtggtaaaattttaataatgttgcaaaaattttttagattacatgcgaccaaattaatatatggttttttacaataggttgacctcctattgtatgacgaatttttacaaaattcatttggtttaataatagataaattaaattaggaacgcgatttttaaaatggtatgtttaatcgaaagactaacacgtgagtaccgaaaggaaagactcatctgaacctaatcgattaaacgcttaatgaaatatatttaactcagttgttgttaccacaatgcaacaattgttataatcaacaaatacatcactaccgtggtttttaggtagtaaagcagtttcgattgcagactgtattgttttctttaggttaagagagtttatacactctcaaaacttggatggtttctttttgaagaaacgaatccaatccttaaaagatgtcatagccgtagtaagctaacgcacgatatttatatcctgttagattataccatcggctttatatgataagtacctgaagttagttaccgtgtaactaacgtccagactagtatcatataaaggcctgtataagcatgctgaagcgcttataagtgaatattttaagatcaatgtgaaat

SEQ ID NO: 2316 - DNA, 707 bp, Xincheng Mosquito Virus
  strain XC1-6 ORF1 (ORF1), ORF2 (ORF2),1
acctattttactcatcattttacagcggtgtttataggtcgcttaatcaaaacttattcaatcaactttttgattaatttctttctttcattttctttaataaaacccgccggtcatggaacaaaataacttgagcgcattggagacattttataaatatattgaagaagtctttgtgctatctgggattcaaggatttgtgacagctgttttaggctatattcaagataattggcaaaggggaggtctgattgcaggttctgattctgattcctgcaatccattttggatctcccccgtaattagaaatcaagacgagtcaagagtgactgaaattgttagtgaatattcgagtcccggaagaaatctggtcgccatgctggttaaaaggaccgtgacaaaggaaattgatagtgttagttttatattaggatttttggctgctgtagtcttggtaatcgcctacattctgataaggatggcaatccaaaagatatgtgacaaaattaagggtaaggctagggatttcattaatagttgtataaggagtcatagggcaaatgttttagcccaatatgcagttgaaaaaggagatcaacaggatctttagaaaaaccctccggtcaaacaacaagtgatttgatagcagttagcagagatttagcaaacgacagatcaaaagttacttcaacagaagaagagttaat

SEQ ID NO: 2317 - DNA, 707 bp, Xinzhou nematode virus 2
  strain XZSJSC33555 hypothetical protein 11
acaaaatgccccctcacttccggccgatatttggcgaatagtctcatgactactgcataggtcttcgtacctggaggattcgtgtagacagccctattattttcctacgggactatagtcgggtgttcgccggtatgggttatgagtttcaataaaccctatttaactgtctcttaaagactttatcttttcattctgaaatcccttaaggatttattgcaacacctgcatcatttgttttggacggacgccgaaagaaacaaaatgttgctgtcgcatggcaaaggactctgatagtcgtttgaagggcttctccggtatgaagccttcgaagtagccaacagcattgtggaagtttggggtcgcgcccaggtggaagcagttgcaagtcctacgatgacgtcctctctcacttgtaaatattgaggcatgtcttcttacgacttgttcgtctaccataagctactgcgtaatcggtttgtgatgggggtcacttactgtagcaggataaacgtgtgatatataatttaccgtatgttttgatctttccttggcggaagcggttaacccgtcattgtatgtaaccacgacttaacaaaatttcacttaagaaagaaagtcgtaccggaaaacgcacccccttgtttttgtgtagccctgccgaacgccgccatttgtggtatcgtcagtggcaaaataagaagaaa

SEQ ID NO: 2318 - DNA, 708 bp, Bat Paramyxovirus
  Eid_hel/GH-M74a/GHA/2009, complete genome.3
caaagatcagtatggtcacctgagcccatcctccacacattcccacgactcctgagtctcgaccccgaagggcagaaatcacaactgacacgaaccccaaaagacaaaaaaagcaacctagctcacatctcaacccgctcactaaacaatctcaattgactgaacgctacatctccaatagattgcgataagccttgctaaccagtttatcaaacagctttgggaattttactctaaatctgaacttttggtcaactaaccgaatattaatctctcaaactatcatattaagggttaatcttgactaaacaaaacttaggaaatcagggcttatccgaaaaagacaaccaacagacgccgaaaatcaacacacacaaggaccaaccacagagaaaagaagaagcaacaaacacaggagagacccccaagccaccaccagaaacaccacatccaaggcacccccaccccccaacaccccacgccacagcccgtccacagaaagctccgacggcccggagacccccaggaacccggaaaccacacaaagaaacaggaccatcggcactcccagagagaccgaaaagaagatcggcgaccaagttcgaaggaaaagcgagacatccaaagaacccgagaaacaaaacaattcgactcacagcaagctcagtcagcaagcaatatcccaggaaacaaccctggtacagcaca

SEQ ID NO: 2319 - DNA, 708 bp, Beihai octopus viurs 2
  strain BHZY60909 hypothetical protein gene,1
gaaacacctagggtgcttccctaggtgttgtttttgctttctttatagctttgacgttatggatatcctacttgtacgtatccatatcctcttagtatctttctttcggcaaagacactcttttacccgttgctttttccttctttgtaagaaattagtttgcggagttattactaccagaatctgattttggctctgtagctctgtaaccttttatgcttacccttacgaacttggactagtcttctgattatgagcttgcctatcgattaattaagacgatcttatattctctttagaaactgacttgtcttcggtcagtggaactatcaacctctaaaagaaccattcatggaccctttctatgttttgctccccttaggtatctccgaggagtgctgggaaatcttcataggaaatgctaacagaatgtctagtaactgaacaaatactactctaactttattgttcaacaaactctatataaggaagtggttattatatagttttatgtcggtggctccaccggaaaaccatgtacgcgcttagacttagaaatctacttgattcgtcatttagatagtatagacttaagaaatgcgggctgatatgcgctgaagtcatatcgctcaaagtgttcaccgagcatagtagtgaacacgggtgctgctttccctgtaagcaggttttcaaaacccctctatttat

SEQ ID NO: 2320 - DNA, 708 bp, Changjiang tombus-like virus 14
  strain CJLX30318 hypothetical1
atgaccgtaaactgcacatcctaactcatggcgattcaacaacttgtacaggcgacttttgtcgttggtattgctcaatcgtgcatcatcaaaccgtttctggcttggaggcgtcgcagaagggctctgattctggatgccaaggatgatttgaacgtgttgaattcaccatccacccttaagactcccttgaatgccttcactgaggtgcattcgcattccatccgtcgtggtgttgcacctgaggtgtcggagatgacgacaatcaggagacggcagcacaaaaccttttgtgcgaagtgggcccgggccgccaaggttcggttcctctttgtacagatgtgtcaggacactccccttaacaggggggctgttcacaggtggttgttgggacagtggcgcgagacgtatcggacgcagattggtagtgatctgcacaagatggatgtgttccttcgggacactatagagatggcgttcttgcccactgatgaatgcgtggcccaggacaagaagtccagtagggaggtgaagaagcaggcacgcatggagttttataatgagaggaagtttgtggagggatggaaatagggatgcctggtgcaagttcctggttatgatagcagacccgttatagataacataccaggggtaagggtgcgagcactggatgatgataagggtcagaagaaggagcggttcgttgtc

SEQ ID NO: 2321 - DNA, 708 bp, Beihai sobemo-like virus 1
  strain HWRTX12503 hypothetical protein 11
ccgcgcccggcatgtttatggctttgacgaagatgagttcgagtccaatggccgaaccattatagtccacgacagtaagatctcaggcgatcgcgctctgcgccgccaggagaatgagcgtatggctgacatcgccgcacaacggaaagctctgctgcgcactcgtgatcagattgcgagtgagcgccgtgagcttgaacgtcaaactcgctcatatagggaaaatctccaacggaaacgggaggcgcttaaagaggctcaaattgaagcccaacggcgcctcaaagaactgaaggaggccaagactgctttcctcaaagagcatgaggccaaagcagccgagctggaccgagctattaatgccatgtccagctcactccctagtgaaagcaaagaccatacgcatgaggattttcggcggaggctgtcaccgggccagcccgagccagaaagtccggtgaagggaaagaaagttacatttcaatcccagggccagcacgatacgaagaactcgaaacctatcgaaactactcaggaatccactggctcgaaagcaccccccagctcatcggaaccgaaacgccctccgttgaagcaccactcacctgggtcggaaactggaaaactaccgcgccgccggaaaaggcgccgcgcggcttcgaaccggaagaagcaataaaagtccttccgggactttccggttatgtc

SEQ ID NO: 2322 - DNA, 711 bp, Ceratobasidium endornavirus B
  isolate Murdoch-2 polyprotein and1
accccaccaataggcgctgaaggccaactaaagcatcaaacattaatcgcatactatctgagaaggctcaaatctaaggctaaaggagaaccaaggctcgaagaaataatttctaaatatgaatttgagcaaaaacaaaatttgacacatacaataacaacaagtggaaaatataacttaagtggaattatacctattaaaaacaattatggaatattactagataaaggcacaattataacttacatacgggaacaagaatgttgggtattaacgcataaaccagtaacaacccactttattggcgataacgatggaaatatagccaaccaatcgagacaaggtagttatgaattaagaaataaggataaatcaaaataccaacatattccagctgaacctgtcattaagaacaccttgacaaaagataaattaagacaactattagaaaaaaaatatacctataaaacaaaaatagccccacacaaattagattacactactttaacagatggacatataaatgaagaatggaaaaaatttttattggatgcttatgatgactgttcgtttatacctgacaatgggaaaatagccgtgtatgggatcataccaggccagttagatagggacccaggtgatgaagattactcaatatggatatgtggtgccaaaccagatggaagacacaaccgaatcaatgacatagtt

SEQ ID NO: 2323 - DNA, 711 bp, Sclerotinia sclerotiorum umbra-like virus 2
  isolate BCS2_DN31091
atgtgcggtggcaattttccctgtcgtgcgctacgacattaaagacgcgtatggagagaccagttgtgccaaggcaaaatgtctgtaaactttggtaacttggacgtgaatcccctaattaacgatacaaagctggggcgtccacacaccatggggcggagccgttcattcggaaagatggtagagggccaattccctcgcatgcagcgcccatgttcaaacggcgtggtggcggttggccaacaccccttcatcgggatgttggtgcccccaacatatggctaagggggggccaacgtgctaatcccagcggtaaattctcgggattgactagggagagaccaagactgatggaaagacatcaaacgaggtgattgaacctgaccgggagagagttcccatgactggccaagcgcgcgtgggcgggacaaccacgcgtacaatattgtcccacgcttatgaggcgtctaataagtgtgtaaggtaagacgagtttcgaggtcgttggcgacccgagatttatgcttaagacgtgtttcgaggtcgttagcggccttgagtacccgctctggttggaattgcctggagggtaaatacgcattcctggctctggaaagacagaatcttgactgctggaaagacagcggcgttgtctggcgcttaaggggcagccccccacagggtgtggtggacgacaccagatgatttagt

SEQ ID NO: 2324 - DNA, 711 bp, Forsythia suspensa marnavirus
  strain pt110-mar-6, complete genome.1
aagtgtgtacaatcggtttgttaaccaattatacatacattattactaggggtggtaaaacaccctagcatggttatagccgaccatgtgccctctccttccaattagtgtaggatgaagcggacctactgttaaatcaacaacggactggtggctctttggactgtataagtaagcgacagcatgcaacgtgcagtggacaaagatccatgtaacacgttgtcataccggtgagcttagaaagaggatattggcaatcccgcgggacgcgcggaaataaattcgttccaccccaacccacgttttgcatattgttagtgttgtgagtaaaccagaaaactctcttatatgggagcatcgcttatagagcgactccggaaacttaaaacaaacagattgcggccaaaacttaaataacttgtatattcaagccaataagatctggaatagtgggcaaagccattaactttggaaatgatctctaggagtaacagcatggtacctatccgaatcgtacaggtagtgccgacgttaaaccatgtttggtcggagtaatgaaccgatctcctttagtgattgtccttagtgaaaactttgtgctaggctgtaactcagctagccggaacccccccggtgaacgaaataggggtgggaaagggacgcaggaaccctgaaaagaaactgcacacgaatcagatacaaacgaataca

SEQ ID NO: 2325 - DNA, 712 bp, Picornavirales sp.
  isolate rfb199shi3 genomic sequence.1
tattggagcagccgcaactttgggagcatcattgggagcagcgtctatacaatccaacacagctaaagagaccaataccactaatttaaatttccagcgagatgtcattagtcagggtgagaagtcttttacggatgctggactaccaaaattcatgtattatggaggacaatcagcaactcagccaaacaccctcttgcaccttggtggatctaatttctatgaacaatcgggtgttaacgcgaatttgccacatttcactacgggaggttattctcaatggaaccatactggaacaactcagcaacttggtaaaaactcagctagaactaactcagtacttgacggtgcgcctcacctctacaacagctttgtcagggaaggagagactgggcccccacgccttggatatggtgattggacagttgtcccacacccgacagcgtactctgatcagtcgattcagacggatagagcgatcacgtctaacttctctggcggccccgctaagccgacaagaaatacaggcacaaattttacgtcaactccaatgtctcaacgttcaagctataatagccctggaaggtcttcagaaccgccaatgtctgaagcagatatcgttaaaggattgtatgctatgagaataaggtaacgtacctcggctttcgccttcacgttcgcaaatgcattagccatagaaaattatatagtc

SEQ ID NO: 2326 - DNA, 714 bp, Beihai picorna-like virus 8
  strain BHNXC41454 hypothetical protein1
gcggctagttgccgcacgctttgtagtagtatttgtacgttataattatcaggttagaagagtactaatactactctctaatctcacatttaactatagatgattacactcaaaaattatatttcatacgtccaagcacgatacgcttacacatacgctttaggttaagaccgtaccatcttaacctttatttcttttggtacttggttactatgtacccgtaattcactagacaatggtctagcacataacaaatcgtcaacttagagagcgttacgtttgctcatgctgatcacataagcatccactctcaagtttttatttaccacgtcatcaataagattgacatcgattcttttctaaacgactgttttgtattgcgaaaagtcatcccaccaacttataaaccctgaatttatagatcacacccgcagtagggttgaacgtgatctttttcattttatttgttggaacaatcgggacttttcggttgcattaatccgacgaactggaacaagttaacaatatatcgtttttgcaagtataatttcaggtagtctacaccgggctactagggttgttcgcagcacccgtcctttaaatacctctgactaacgattgagatagactagaactatgtccataatttggtaactgacttgttgaataataaaatcttttgatcaaacccccagacttgttttcaaaataatc

SEQ ID NO: 2327 - DNA, 715 bp, Unknown
  Description of Unknown: DsRNA virus environmental sample clone mill.culi_contig891 sequence
ccgggccccggcttatcttcccacaacgctctcgcatagtgatactataggttagctatgcgggagtgacaggcttgcaaacgtggggttacgcaagttgggcctaggtaccccttggggtgcctaggtctgggcgggagccaagccacggcagtaatgtcgtggcgcgattttctaggagattcctagagtctcctagaactgacttacatctttttataaacttcttgatggcaataccccattaatctcccaatattataaactctatagagtttctttgagagtttgcgtatgtataacgcaaggtttctctctaatgcgttgggtttggtcggtattgcgtcaataagtttataataactggtctgtcagcccgttctgattttgtcctgtgttcttcctactctttgctttgtgtgttttatttaaagccgactgtatgaatgtaagcttatttctaagcttgcaggccaaaatcgtcagcaaggggttgatagccttgcgatagggcgtgctaagtgtgggaaaccactaaatgccgagagactgcaacggccgtaattcatatggtgcacagtcctcacctactggcgggtagctccggcttataacaccagttctgtgctatctttggatatttggaagtattttggaagtgattcgatttgtgaaagtaaaagtttggaagttctttggaagttttcgaaagcgt

SEQ ID NO: 2328 - DNA, 716 bp, Heterobasidion mitovirus 3
  isolate HetMV3-an1 RNA-dependent RNA1
ggggtagactctcgtaaagagagcctatcacgtccaaagactaggacgtagatgatcagattcatcgtaatgtgacatcgccgtaacgcaaggctacggaaaggaatgccgagagaataacttactctctgcaacccttagtgtaaggagtgtgtcgttgggtgttttctgaatacctaagagtagaactcttatgttaagatctcagccagggttagtaacctggtgagcaatcgaagcataagtgttcccacttatagtactcctgttctcctccataattgccgtcaaaagcaagaaagagtgcaaaacagaaccgtactagacgtccccgcactgcctacgcgatctgtagaaggtaccattggaggtccttccggggcggaatttcaccgctagtgaacgaaacgatttcgatcgttctctgaaactgtgtgcgatttccattaaaatcagtaaacaacgtataattattaacgatacttgctgatggacggataatccactgtaaaccttaaaggtaccttatggtatatcaggttaaaaactgatgaaggggtaaagcaattcaccccaatccataaggaggtctacctgactctcctagagtagctgcggccccttgaagtgatgtagaaatatataacttcttaaccttcgtgagggaaaccgactttgacacgaccaaacttgaggcaacctacaattttaaattt

SEQ ID NO: 2329 - DNA, 716 bp, Riboviria sp.
  isolate cfe153shi01 genomic sequence.1
tagaatatacaaaatatcttcccttagctgtagtaacaagatatgctgagcctataagggtaacaacatttgctgctagagaagtgcacaaacaagtggagaggagtgtagggctcaggttaagagccttcaacagattagctgtgaaagcatccccaacctgggctataaccccagttgagggtccagcttttgattgtaccggcatattgccgaaaatacaaaagcacaaaaacgataacgatacacgtaatacgtatattcgtttttgtgcttttctcaaaagtacagcttgtttacgcgattttctcaaaatcgcattgttttcgcgcttttctcaaaagtgcatctgtttattcgattttctcaaaatcgaatttgtttatacttttctcaaaagtaattttattttatagatttcttcaaaatctatatttgttttatcacttttatcaaaagtgaatccgtttattagattttctcaaaatctaacattctatcatatttataaaatatttaaattttcctggcttcttcaaaaccaggaacttttgttggatattttgtccaacacattattattaaattattttaacacaagtattaggttttacctgatatatgtaaatattttagcgctttttataaaagcacacagtttacatacttggactattcgcataaggatttgccaagtattaagtattttcggcaat

SEQ ID NO: 2330 - DNA, 716 bp, Wenling picorna-like virus 2
  strain WLJQ104117 hypothetical protein1
gggaaaacccctccgtgcaaagtaacgctcctcaaggttcgtctgcgactaagcccaatgaactgtataaacccttgaagttactttgtgcaacatagtgtatttctcacgtgctttatttaacttcaactcttctgtattatcagacgcaagcgtagattgataatacttatcgagttgtcgaacacctctgatttatgaacgatctcagttgtaatagagagaacatttattgtattagaggccatatttattgtgatgctagtaataatcacttcattttgaatgtgtaaagactgctgctgcttctaatttatttgctctataggggtcatcccatcctatagcataaattatttgtggaaattgagttagtaataacacagccgctctgctagtatcactctatctatggtcctattacaatacttgctatcttagttcaacctctacattccggcagagtgtagttgtaactcaatccagcggctcgaccccgttggatgccactttataggcgacgcctagtaaaacctgtgaagaccttgggtcgatcagagctcccaatgtggatacattttaacagaccaagcaattcaagcaaagggctcacttatgtgaaaatacctccttgttttgtggctccaagtggatcatgagcccccactagaatgtagatcataagtagtgtactgatcactgaccctgtctgagga

SEQ ID NO: 2331 - DNA, 717 bp, Wenling yellow goosefish hantavirus
  strain XQTMS34106 segment S,1
cccagaaaactaattgcaaactcaaaacctcaatctacatgaagccgacagtgacactcttaaactggttgtcaaaagctaaacttggggcaaacgcagcaagcaacgaagaattctttgttgtcctctgcttttggcacggttacaaggcgattgggaacgaaagtgttgttagctggtggagaggtgcagttaacgaagggaggccacaagaggagaaagtgagcgaagcagagtttgacgaagcgattgaggctgagagtccattaaggaacatacagataaccagaggcggaccaagtggtgaaatcctgtaccttgcgacatctgaagagacagttttgtttaatcagcaactgtctgatcaggggtttgattgtgcaagttgatggaacagattttgacttgggctgagaacaagggtgtaggataccatacattaggagaaaaagagaacaaagtgttcttgtgttgctggacagcatataataatcgcggctccaggtcaacttgtgaacattggataagagaaggttgcggaaaccaaacagagactgaattccaaaggattagaactaagttctcttggtgtcacagtctcgctacttggtggccacatcatctctctgggacaaaagtcatcatttgggagaaagccgttcccggcacggtattcgtaagcccacttaagaagcacgagacaacaagtcgatagtc

SEQ ID NO: 2332 - DNA, 717 bp, Beihai picorna-like virus 47
  strain SCJXSX39359 hypothetical1
cgtggattaacacccacgcaatgatgcattcctcaggaattcctcggaagctattgatgattgaactggctttctacggattccccagaaattcctcggatatagtgaatgattgaactgagcatccatcgtttgcaacgcattttatttctaacgccggagacggctttaaacatctacccctttatgtattgtctataccgcgtgcgcaagctgcacgtgagtgagttgtccggccccagggctatgtgattcgtctaagttaataatacctctcgacgacgaattcacaaccttggtaggtcggttgcggcttatgccgctctcttataaacaaataaaagaaataaaaattagaaaataccgctaaaacaaaacaaaaaactttaattcgaacgtacattttgtacaacgcttatatatttctattttctgcggtatacgtaatgaaagtcatggttgatgactgtatagatcgatgtcatattggattatggaaatccactcactgacaaaggatcaaagcctctcagatttgacgctttgacatgtacacgaatcctagtttactagtatggaagctatgatctttcgttcatcctatatgtgaaaaccagatagggtaccctcgatgtactgaaactcagatagagggatgggacctcgataaaagaccctattaaatgaaagttacttacgatataacgatataaaacg

SEQ ID NO: 2333 - DNA, 717 bp, Hubei toti-like virus 13
  strain QTM25941 hypothetical protein 1 and1
gcctgacacgcagacctagccctctttgcctgccgtacacagtattgtacgaccattcagcagggaactcttagagtgcgagaaatcgcggagaacaacgtttatcctgaaaccctaaacctgcgacaaccatcatgggttacgtttttttttgagtctgagagtaataacatgtacccgaactctgagtcagtctaaaaacacgcggtggagtggcatgtcaaccgttgtgtctgtggggtgccacccgtgtaataggacaagataacgaggggagagagtgggacttaccggtaggacgttgagtataaaccttcagttaaagtaaataacggcataaatatggaatcgaactttaatcaaactgataatagggatgtactagtcaacgaaaattcagttgatatagtggacgagacgtcaaggttagttacagatgtgttgtgcgtgaacacattgtacgctaaagtggaacgccactggatttggaccattggaattaacgtggttctgttgtgtgtagtagtcatattgggaatatggattggactattatacattcagcaacaggaacacgtttctgaaatcaaaaaaatgaattacggaattggaatgatgaaaaaatcagcaaatgaatcggaacgtttgctgttggaagtgtgcaaggctgagttcggccagacagcttccatttgtgaactcaactggctctagtta

SEQ ID NO: 2334 - DNA, 718 bp, Aedes vexans iflavirus
  strain Barkedji Village, complete genome.1
ccagcgtgcgcatctacctcagggaagaggtccgatttcatatctcagtttcttgggatatgttgtaattcggatagtagatcctacctttggaatatgggtaaaagttatatttccaaaaattcaataaatatatttataagttagttcacagggctataacctaccccttattagtaacaaaataaataaaatactcggtactgaccggggtatattattgtatttatagagatcaaatttagtagttcgtgggaaaactatggtcgttttatgaattatcgttctttggaggtatccatttactggcttggtcagtcaggctcgattattcattttatattttgctctctactcttacaatgtatatgtataaatatagttttaaggcaaggcatagataataaagatatgttagtaagtaaacaagagtacgcgacgttatgttgtatgaaaatagtcattgacttaccagtagccctggcgtaaccagtaacatagctattggctcttgtcggaagcaaccgctactttattatcgtatgtgacagatttatctacaatacgtgttaacctttgtgttagaacctcgatgatatgtgtatccatagacttcgggtatatgctttctaaaagcatgcacgtacttctgaaccgtcattatgagcgttagacgacgaaggaatatcgactcatttccctttttaaaatcttactt

SEQ ID NO: 2335 - DNA, 718 bp, Wenzhou yanvirus-like virus 1
  strain WZFSL78003 RNA-dependent RNA1
cctggcgttggcataggattagttagactaacttcacacctccctcctcatcccgattagttagttttgcactataccggtttttggagttccagttctgcctgttggtgtgtaaacgttttgagccaggttcaatatgtgtgaaaccgagcggggtcctgcactttgatcaccagtaattcttcctgagaagtttccgtcgctctatgggagatggcagcattgtgcaactgtacaacggacgtacagtggatctgacaggggcgtcgccacgcgtttgagagacgtgttaataaatatggcggccgggcctcttaagcgcgcctacgaggagcgtccaaccaagcgatggataggtggaggtgttccggagccccagcggtagcttccaccgaaacatagtctctctaggggtccgagcatatcaacgggtaacgggctgtcactcctttccttgtggaatctgtaccattctgatgcgaacgcggtacctagtacctcggtccagtcagacttctttttggacgtgtatgccaatggactgccattcatcggcacgcacacatgttatgctgtccctccccctcctgccgctgctcctccggcacttccacctccggtgtggtcgtgcaccaggtcagcggtgacaatagcatactttttagtccataggaagcttctcccctccccaccaattcgggacctcaccgttcccgga

SEQ ID NO: 2336 - DNA, 721 bp, Picornavirales sp.
  isolate rfb200shi4nc genomic sequence.1
tttcacaacgaaaatggccgctgctgcacttgctggtgccgctctttcaggaggttctaatataatcgcatctttaggttcaacaggattacagtcttatacatcattaaagttacaaactggcgaacaaaaatacaatcaaaatgttatggacactgccacaaaagcttttactgatgttggtttacctaagtatatggcctatacaggaaattcaggttctcttcatttacctggccaacagtaccacgtttctggctccaacttttattcagctggccttgttggtcaatcagttccttttttatctactccgtatcaagcttttactcatacaggaagacctaatactaccgtaaatcaaccctctgaaagaagagcaggattaggtgtgtattcacaggtacgtccctggaatgagcctcaaaatgtaaatgagctaggaaatacttcttaccaaaatttgccgataaatagggctctaatggcaagtatggctcggaatgagaaccctaccggaaacatgcaaactttgccgaaaacaaattttacaagaagtagttttcctactgccactccattacaaaattttgtaggtagaaatactgaactgcatcaacaggcagcccgacttctacaatgacctgcttagtctagttgacgtctggtctattttctttccaatcacttagtgtagcgcttgtattggttaatcttaatt

SEQ ID NO: 2337 - DNA, 722 bp, Human rubulavirus 4
  strain t146a296_HPIV4, complete genome.4
tcaacaaagttattctgtaatataaactaatcttatgagtgaaaagatacccacacaaggtggtcgatagacaaacagcaagagcagcaactgcaacaaaacttcaagggaaaaataattcgagaaatataataaattgacctcagagcaaacacaacatcgatccacaatagtcaacacaatcaacaatactccatgaggcttcacccatcaacagcaaaaagcacagtccattaagcagagcccaactcgcctcatcctcaaccatccactgaaagaaaaaatacatgaaagacctttggccaccagatccaaacaatccagcacaaaaattcaaacaaccgcaacactccattcggcctcaacaaacaatccgccaatctgtccatcattcccacactgacacacaaccatcccattcctcaccagcaacttaatccgcaagtcaaggaagattctccatatatttagccagtccgtcaatccgacacatcatcgtattttttaagaaaaaagagagatgagcaattgatacattctattttccatacgtatagtaaacattaaatcatggattcaccatagaccaagaccagaaattgaaagatcagaatgatcttgaacagcgatggataagcattgagaaacaaaaaagatagattatctccaacaacgaatggcacaaagcatccaacaacaggggggaagagagcacccccaag

SEQ ID NO: 2338 - DNA, 722 bp, Sanxia picorna-like virus 3
  strain SXXX36208 hypothetical protein 11
ctctcttacaaaattttgaaggatctatcttcgatccatagaatacattattgatttgtattttatctatgtaaggaaaacagcactttcgttttgccggattatggaaattaattcggttatagtacgaaatggcaaaaacgacggtaaccaatcagagaatttcattattcttttgattgaccccgtggctttaaacatatgcgtgatagtatatgttaagcaaacaaaacattttgggtaaaaccaaaaggttccatctgttaagaggaataaaaatatttaccacttttatagtggcggttttcactaggtatttagtgttgctcgtgaagcaatcctagaatattaaacgaacatcttttacgaagcacattgctcgcttgtcgaagggttttataatttactgaaaaacgagagaagacgcatgctagaagtatgtagttgctccgtgcacaccaccgcgcgtccgcagtttaacgttctctcatatctttgcacgagatatgtttgacgaattagaaaaacaggttttcgaaggagaccgttttgatttacaggtacgtgaaaagtaacctatagggattaggtacggcattcagactctcatctggacgtaagtccgctaatactataggccaagatctcaatcggattggctaaatttaagactattagttttttaattttagtaccaaaacaacaagagcccaaccaacatc

SEQ ID NO: 2339 - DNA, 723 bp, Soybean leaf-associated negative-stranded RNA virus 4
  isolate1R
ccccagacatacagccagcccagcatcctccttgagatttcacatactgtctcctgtcccccatccctatcacgagtccggatggagaaatataaagatccgagaagagacacaatgtatccttccgagatcaaaagttctgctggtaaaagagtagctttctttgtaatgcctaccggacatggaaagacgcatcagcacagtcctgaaagagggatatacgatgccgccaccatagttcctccgagcggaactgccttcctccgttttgcgcgcgatcatgggaagaagacggggaaatgggacacttatgaccgagagtggactcgtcttcttgtagaatatgtggagagtacaataggtaatatagtcgttatgattcctcattacgcaaatggtattcgtgcagggtgggtagatatgggaggagctatcctgaccaggaaagcccttgaacataactttagagagaggaaagacaaccttgagtcatatgaatattatagaatggttgaaaagaggcgcggtgctcctgagtttgaatctaacaaagaacttgaaaagtgtttgctattgaccgcagaaaggtggattgttcgaggaatagacgagccttccaggattccctatctccttgactactaatcagtacgtctgtaataactattaagaaaaaattcgagaatagactctcaaattgaaaatttctaccaagattacatc

SEQ ID NO: 2340 - DNA, 724 bp, Rabbit calicivirus
  isolate BEN-12 capsid protein gene, complete1
ttgtgagcaaactgaactcacaaaaagtgtcgttctgaccttgaagtcgcaccctatgactattcttgacgcaatgatcattcaaaccaaaagaggacttccaagtggcatgcccttcacatcagttataaattccatatgtcattggttactttggtcagcagcagtttataaagcatgtgcagagataggtctccactgttcaaacctgtatgaagatgcccctttttacacgtacggtgatgatggagtttatgccatgacgcccatgatggttagtttactgcctgccattatagaaaacctccgtgattatggtttgtctccaactgctgccgataaaactgagtacattgacgtgtgcccattaaaagatgtggcattcttgaaaaggcatttcaaaatgacagacattggttgggtgtctttgctcgacagatccagcatcctcaggcaacttgagtggtgcaaaaccagcaaacggcacatgacactggaagagactcatgaccttgcaaaggaggaacgcggtgtacagcttgaggaactccaagtggtggctgctgctcatggtaaggaattctttgacttcatcaagccagagttgatgcgccaacaagcttacacgaagttcaacgtgtacgactatgacgcagcttggaaaattcttgcagatcgcaagagggtcgtctcggtagtacctgacgacaattttgtgaatgtt

SEQ ID NO: 2341 - DNA, 724 bp, Wenzhou picorna-like virus 29
  strain BHBei77092 hypothetical1
ggggggaggggtaaaaccctcctctccttttggcacgaacagagattcctccttgttaggttaagtcctggtggtggatcactctcccattaggttaagtcctgactttgactgtccctctgtgctatgtcgagattccttgtgattaagtagtaagtcctgaccttgggttaccccactgttaggttgtaagtcttggtcccaactaaccctcggcgtggctgtgtcgaactgagaacctttatttgtttagattaggacaagcgattttctttgtcgctataagttcgtcaggcattgcttattgcctgtccctttctatctgtcccagagtcctgtgactattcttgtcccaaaacattgtagctgctagtaccatcgtgtgttgattattacaggtaacagcgtagatcttcactggcaacagtaaagcacgacagcggaacgcagagcactatggtgtactaaggcacttatagtttctaactctatctttttcgacaaccggatgcgcatgacgggattccttctttaggaatgaaagggtaattattgcgtagtcgggtttaccggctattgtctactcgttgtgtgttaatgttcgcttccagaacagtccgaaagtgcactctatttctttcttcagtgtgtactgccacgtgttgtcttcttagtggcatctctttaacccgctagggatcttttatttttgcaattttaatat

SEQ ID NO: 2342 - DNA, 724 bp, Shahe picorna-like virus 11
  strain SHWC13613 hypothetical protein 11
gtaaacttttagtttacatcagcctttaaggattcctcatgggattctttatttcaattggattgaatagttactttaagtactttttgatcgaagaatttattcgacggtcttaatttattttccactgttctttacattttgtcttatgcaagatttttatttatctatcaccggatgaccggagtgaatattaatttacatgatctttctcactatgataaaagtgtcgttttattcattttacgttaaaatgtttcccctttaattatattaattatttccgtatagttacctgagctataattcaggagtttgtgcaatacttgcagttaacactgtaagattgataaagattttgataaatcacatactgtccccaatctgtacacaaggatgtatttatagtcgtagtttttattctatgaagtagaacttacatgaatattattaacgaaagtgtgaacaggatttatttctattataggcgcgagaaaccatatcaattatgatagtggtaggacgtggttagaaagaatcagtttccaacacatattagtttttattacatagaacacgatgcacaataacgaaaaatacttattaaatacgtgcaccatacttgtgatgctgatagaatttcccaattagacaatgactcaacattattgatcgacgtggattacgtattctaaaaagctggtgctgttaacctaaagagaat

SEQ ID NO: 2343 - DNA, 728 bp, Lampyris noctiluca iflavirus 1
  isolate 17FIN2, complete genome.1
gtggggggaaaccccacgttctgcaaagtgtaataacccttaagcccgtttcatacgtacctcactaaattgttatgaccactggaggatgctttgtgttatcggtctaaccacggccgagagcaattcatttcgtagatagtgttagtaacatgctggttgacacatacctgacgtcaataagtaaaagactttgtagaatgtagttcgaacccattacctttaaaacccaaaaccaaaactttcttatcaattatgaagaggattaaacccctaatataattgttcgtgtcattgcgttcaatgacttaaaaccatgcactaaagcaagtttaattttacgagcttttaaaatttggcaaatttttgtaagtgtagctactcaaagttttcgcagactttgttttaaactgtaatctttagatataattcagcgactgatatttgcgagatatcggaacgttttatattctattgaccagtgatattaccttaattggttgtatcgagacatagtaaggactataaccttctctcaaacggtgtgtttattagtatttcagaagcacaaacgttttcatattttatatgttggtacttgagtataagtatccctattttgaaacccttaatggaactgggaaccattattgtataaaccccttaccaagttatgatcgtagtttcttggtggaccgttaaatcgatcactactcgtgggaacaatt

SEQ ID NO: 2344 - DNA, 728 bp, Niviventer confucianus picornavirus
  strain Wencheng-Rt386-11
ccacgtgtgtatgccaacctacatggactcgtgcatgtaggttggattcacaaccctttcataaccccccccttttaacccaacccttcgtaaccgtacgcttcactcgcctttgggtatagcggcccaatgtgctgaagaaaaggatacgctataaggggccaacgggtggtggcccttaagaccacccaacctagaagcttgtacactcgggcaatagtgaggcccacatccagtgggtcaagcccaaagcattcttgttccccggtatgatctcataagctgtacccacggctgaaagagtgattatcgttatcccactcagtacttcggagagcctagtacaccacttggaaatggaagtctgtgatccggggttgaccctgaaccccagaaactcatgatgaggctaaccttcccgaacacggcgacgtgtggttagcctgcgctggcatgaggcctctttgtaggcagactgaaatggaagggtgacgaagagccgactgagctactgttttattcctccggccccctgaatgcggctaatcctaactcctggtccagtacttgtaacccaacaggtggctggtcgtaatgcgtaagccgggagcggaaccgactactttggggcgtccgtgtttctcaatattattcatttctagcttatggtgacaatttatgattgcagagattgtgctgtatttgtgtctgagagaagaagtaacaat

SEQ ID NO: 2345 - DNA, 729 bp, Fusarium sacchari hypovirus 1
  strain FZ06, complete genome.1
tgcctgtaaaatccttcaggtgtttccttttggaaactaggagtgagaacaccacgctttcagtggtcagtatttgtatcgtttgtgttcgaatactactggctgttatcttttgttctcgtgagctttcgctcgtggcctttggccggaaactctattgagttttgtgggatttcctcccgtgggctttgcccgtggcacttgtgccgtttactccgaaatgagtgaaaactatttcaaatgcatgttaagacctcaccgcaaagtgtataaactaacagaaggcataaaacctgatgaatggagtagaccattcacggagaaccttattaggctgcctgtataaccgttcttcccacgactttatcaatcacgtagactgcggtccataatcgtgtttaagttgagactcgtcagcggagtcaagaacagaacgttaaaataacgctgattaacatgctttcaacatcttccggtggacgtttactggttaactgtatttggtttaaatttgaggtgtgacccctaccttcaagctaatttgacacgaccataccctgcgtaactagaaacctaacaagtcgagttcgaacttgagggttgtgttatgatatggtggaatcgtcaataatgaaccttgttaaagagccaattagcacaccgtgatgctcggttttaaaattttagaatggctgacccggcctagatgggtgtgtcacgtccaagaac

SEQ ID NO: 2346 - DNA, 731 bp, Caliciviridae sp.
  isolate hwf182cal1 genomic sequence.1
tcccgtataagggaatggacatattgagttaacaatatgccattcccttatacgggagtgagcccacgaccgttggggtttttaccccaccgttcgtggacctcatttctgcttattacttcccccactttcatcggggacgttccttttgccgcacacccagtgcggcaggaggtaacgagtttattttgtatagttgttattagtcacaccggagggcgtgctttacgctcttaagggcttaacccactccgttgtgcctgtcacttgtcgcttgacggcggctggtctagtacgggtctagttagtaccactcagtggtcagggtgtgccgcccgttgaaggctggtattcccgcgtgagggggctaccgtggtaacacggtccttgcgtgtgtgtgagccagtatgctctctggagctgccattgtttgggaaagctcttccccgaacaactaagtgcctgatggcctcatttggctgattggtgctctcaagacatgtgccggaggcaagcttgttggaaccaccagcaagccctgaccggtagctaattagtcccttgacggcatcgaatttttcctttttccttttctttttgtgaactgaatatagtgatttgtgtttagtgcttttgtgcctttgtcacttttactttgtcaaatattagtgtttgtgcatttgttttaaactgcaacttgttgttaatttttggacaatttgaacttagac

SEQ ID NO: 2347 - DNA, 731 bp, Picornavirales sp.
  isolate RtCb-PicoV/HeB2014 polyprotein gene,1
tttgaaagggccctggatataatagggttaaacccctattatatccaggaattgccaacccataatccattgtccatcaatgttttatgggggggaccctttctcccctccccctccaaataccttttacccctctgtaaccaagagtgtgcaaaatctatttactagcccagaattgcggcttctggggaggtttattcctcatgcctaacaagatgttacgcaaactccgggctacggccctgggcttttgccctaaagatttagaagtttacactatcgtccaacaggaggacaacaaaccagttgttctaaggacaagcacttctgtttccccggtgagactggatagactgtacccacggttgaaactggttgatccgttacccgactcactacttcgagaagattagtaggaaactgtgaaactgattccattgatccggatactttccccgtatccagaaactactgatgagggttgacttcccgactacggcgacgtagtgtcatccctgcgctggcagtaggcctctttgaggatggaagatgtggatcggtaaccgaaggtcctattgagctagtgtttatacctccggcctcctgaatgcggctaatcctaacccatgatctagtgctcacaaaccagtgagtagctagtcgtaacgcgtaagtcgtgggcggaaccgactactttggagtgaccgtgtttcctattttacttttgtttg

SEQ ID NO: 2348 - DNA, 732 bp, Wenling triplecross lizardfish paramyxovirus
  strain XDLYMC449513
accctaagtgatatcactaactgattaagcaaaacttaggatgaagcagttggaaaacagtttctcaacatttaaattgtgcatacgtatctactttgaaaacaaccacctggggaagagatggatgattatacaccaatcaaagatattatatcagcagaggccctttctgacctgacagcaataataattatcattttacagatccacacggagctcggaatcaggccttatcctttcagtccagatattcatgatagatttcgagtattgtctatcagagctagtgatttcaccagacttagcataagaaggagggatctccttaactacgggatagactcgttacttggaaaggctgaaccgaatccgcagattgcttttgagcttgctagagttaggctgctcttagatctcctaagaaaatacacccacccttatatagagcctgacacaaagaaaacaaaccagaaatgaattaagatctctaacgatccgatatcagatgagttcggataacatacagatgattaacacctataaccttcttaatattgcatttgaacaaaaagaaattgatatcaatctgagtttaacaatactgtaagagatcatatactatgattttggataattaagaaaaacttaggattacacattatatacatcattctgtgtgacaacattcatcaaactagcttcaaaggcgttagcctctcaaaaagtgtcagt

SEQ ID NO: 2349 - DNA, 732 bp, Helicoverpa armigera iflavirus
  strain HBLF2013-1 polyprotein gene,1
cgatctcgggtttaacccgtgcagtgcttttaatagattttcaatattctatcgtttatctccgactttattgattagtagcgtctcttgttcatttttcagctcgatttttatcgttcgtgattttatgttcgttgagacgttttctgaactttgttagtcggagattttgttagaatatctttttctattaatgcattagtagtttaggtttcttttgcttagttttgtttattctggttttatctccagtacaattggaatattggaaaactttgccttcgtttcaaagagccgggctactttcccgtgcatgttttatttcctgcttactgagtgtaaagcttggttaccgtagatgtattaagttatgtaatgtaatttatgcatcgttaaattctctttacgtattatcgatttatcctccggatagataatgaattaacggattgaattttcggtaattgagtgtgtaatttcaggacccaccgtgagcagcgggtgtagagcgcatatcttggtattagttgttaattttgaatactaaagttaattgatttcttgaacttagtgtagtcatgtcttaccaatgttcaagttacggcaattaattaggtatctattttaacttgacaagcccttcatgcggaagaaccgaagttgtggtagttggctagtattaacagaaaatggggtgcgtgagctacattagtggtgtaactttaattaaat

SEQ ID NO: 2350 - DNA, 732 bp, Robinvale bee virus 9
  isolate VN3-31 polyprotein gene, complete1
ggtatcagacccgtcatcaccttagcatacgtaataggtatctttagatcattctaaaagcattctttctactggagtacactctcctatatcaaaagtgaccagtgtatatggttggtgaaccattgtaaacaatcaccgtagctcttttaacgttataaagatggaattttaagctactaaatctctaaaactctgtactcaagccatgttaaggcgaagtaccaagataggggttttaccctcatcttgctcgtattgtgatgcgttggtgcctgatctgggctaacccaatacgtgatacatatacatatatagcactatgtgctactgcattaagaatttactctatgggtataaaaaacataaattacaaactccccatatagatccattttagtgttggatttctaatacactatgatagcattttactatgttagtaagcggataatagcagccgctggtcctacgttacatataatatatactaacctctccgtgaagcaaccttccgacgttactatagaaaactctaggataccctagtaacctctccgctccgagaaaggacgacgttaatactaatcaactgattttgtgtaataaggcgttcgctgaacactagtttaattactaatcatgtaaaagtcaagattgaaggaatcacaaccttaaatagtgatagtctagctagacgataaactcaattaagaaccagagtacaacaat

SEQ ID NO: 2351 - DNA, 733 bp, Kimberley virus
  isolate CS368, complete genome.1
ctaattaaaccgtgtacctcaatattatatataatccattgcatgagtaatgaaaaaaatgcgagcgacctttaaactcaatatgaatttttgatataaattaatcccaatttaacaggcatcatggagttttccagatgcaaactgagtcttcaaataatcaattttaaacccattgagattgaaagaagagcactactaggcttgcttgctgttaagagtataaagaccttgcacagaggtaaccaaatgattacaaggctttctgagatcttgataccaagtgcaattgtgaatggagaatttgttgttcgaaatgataaaaagaatggttactgaatctttgtgggggaggcttatggagctatagattcagatgatttaagaggagtcagagaaaaggtgatgaaaattagcagaaccataccattgattatcacaggagaggaatatggggctattgatttggacataacgctagaagattccgaaataatattcttaaaaagaaagaatgagcttgacatctgtgacttacctcgaaaaatgagatttctgcattgagcacaggcatcaaataatacttttattcacgctccaataaatggacaagtaaataaaggaaccaaataaatccttaaacagatgaaaaccttataaacatgaaaaaaatcaaattctcaagctgagacccactgtccttacgataggtaacttaagatcaacaggcatc

SEQ ID NO: 2352 - DNA, 734 bp, Halophytophthora RNA virus 2
  isolate HRV2/BD641 RNA-dependent RNA1
atgatggtgataaacattgaaactgaaacaaagagctttgctgcgcagctgggcaactctgacaagaaattacagcttaaggaaattttcaaaagaaaattctgtggagacttcgcaagtcaaaaatatatttccttcgggagccagccatgtttggatttaggtggtgaaggtgattgtttctacagatgcatgtactactcattgcctcactcatttcaagcaagttatgcagaattttatagcaatttttctgatggccagtgggttgatgaagctaagatcatcaggttttgtgaaaccttccctgtgaagatttttgtgcattacggtgatgaaaagggtgtgatcaaacaatttggtgtaccataccttctggtggtgcatttgcttctctccaagggtcattacacattgatggggtacaaagaaacggggccttttatgcaaaaactactgatgtcaaataactaccatgcttctgcactgtctgaggatgtttatgactctattagcagcctcggcgtaggcttcatggaggattttgaaattctttgcaaaatttataggtcttgtccgggtttagttaccatgccaaacacaaatgtggaagttgtttcaaaatgcaaagatatgttgttgaacaatcattaccatgaaagaaacaacacagatatggtagcacacatccaagttatgatcaattcacttctttgtactaatccgggcggcag

SEQ ID NO: 2353 - DNA, 734 bp, Solenopsis invicta virus 4
  isolate Gainesville-Sin, complete2
tcgctttagcggattgtgtttccttaggttaagaacagtaagctttttgctgagtagtaagtaatgcgtaactcaagaaatcccgcaaggtttgaattcttgagaccactgccctgctgagtcatggtctagtaattgtagtgcaatacttatataacagtcaggccactaagaagtaatctcttagtttgctaaagtcctgaagaaacgatggaactagcaattccggactttccatagaggaacctgctaaatgtggatgccaccccagagagctccatttagtatgtcagatataagtatgaatgcaatgaatgatagtggcgaccccctatgggacccctcataggtaagcttggtatgtcaagaacactctcatcctaaagttagaacgatctgttcagctggagtttaaacattatgcttacatgtttaagttgtgcttcagttaaatcttaagccggtttcgtactgggacacacaaaccgttaatcttccattcgtggctagattgtgagtacccaattttattttgtacttaatgctgtttattttgctgtctattgctgcccttgctgttttattatttgctaatttttgcttatataatttgctatttactgctgctataattgatactttaggaatcaatccaatcgtaaaatattgcgttataactctaacttctgttttgcttatttttgctattatttacgaattaataaagattaaac

SEQ ID NO: 2354 - DNA, 734 bp, Beihai picorna-like virus 83
  strain BHWZXX15514 hypothetical1
tagacgtatgtctatgcacactttgttaacataacccggggcttgccgcctgcggggccttgtaaaaaggatactccaataacggtttgactggatagcctccagtcagggttttcccgccggctatgtagcttgccgctcatagttaaattggactccaatttacttggtgttcaggagaagatgaagaagtttgggagttttaagtctgcctgactgtaaaaggcaaccccctccttagccagtgagccatgtcgcaactaaataagtgcctcgctcggccccagtgggaaactggataaaaagactttccccgttttgttagtgaacgaaatcacacctatatcgtttgatagtaagcaaacgcatgtttggcagcgtgccctttgccactggatacgtatgtagacgtagcgatggaggacctgctccagcaggtatcaacgcaagggatttgaagaccttgtagcgaaatcgcatttaaatagaatcgtggcggattctagcctatctactaaggcctcattttgtatgcaagtactcttgtgatatgcgacgaacacggtaggatgagttcagtaccgcccctaggatgatctccttcggtgacgggaacaaactcgtttatcctgctgctagtaagcaatttgaacgacagaacgtgtgcaaagtgggattccccgctagtcgtgcctagactttaaattggcatttctttttctctttccctcatc

SEQ ID NO: 2355 - DNA, 734 bp, Beihai weivirus-like virus 16
  strain BHZY60618 RNA-dependent RNA1
ggcacatgcattaattcgtctgcggacgggaaaggatcacagatagcatgcaccggtggcttttgaataccaccatgggaagtcggggaggcagtttggaaactgtcgagatgtgggagcatgggttacctatacctggcacattcgttcacatgtgcgatccatgcgcggttgtagcagaccgttctaccacgggcttattcttccgtgccgggcagaatgccaatgtcccggtcggagcctgccgcgagcctacagggggccgctgaggtgaaggctcttcagatttccgcatcccgggcggttggggaccagccatccccgtaaaatctgaggattgtactctcgtgctgctaccggaagcttgactgcaagggagtgggcccgaatccggaaggtgaagggacagtcaggtgaccagccaactgtgtgtgaaagggaatttccagcccggggatcacatggaaggtcggagggtacacaaaatgactacggccgagcgccctgcgatagtgggttgacttgtccggggggggacgctccatgccattttggctcgcttttcgtgcaatggatgacttcctcagcgcggggactgttgcccgcgccgccgcggttgctgcggtgttattttcaatggcatcatttgaataattaggcaaaagtgatcctcgacttgaaccgaaaagctcacatataaacattgttgtttaagtgcacgtgacatttcgctt

SEQ ID NO: 2356 - DNA, 736 bp, Rhizoctonia solani mitovirus 37
  putative RNA-dependent RNA1
ggggccgtgaggctccttatgagtaatcgaaatctcgattaccagcgataaatcgcacattacattgttttgtgtagttcgtcgttccccaacagtaacgaaggggatcactggaggacttgtcgtagctcatacggccggtgttaaggtggtctcggcagaccaaaacctcgttgcgagggggttccctaccagaaatggtgttaaagggaactgagaaagttgctctcccaagagtaaccgtattgcgatataggttatcgtctgccagtcgtctaaggcgcaagccttagaagacgcagtcttctctgctgctgcggcccctgcgaaagcggggaaaccgaagttttatagagcttattaagattattaggccctagggacagtataccaggcactggtcagtagaccaggcgttagtacctgaaccctgtgcgaagaaaccttaagttcaccctaccagcgagagcgtagtacgactcctggaaagagaatttaagaatgtattcacccgaatcggattcaaatctttttggatctgaaggcggtcactggataccatgcatggtgctaaggggaacccgctttggaaagctggttatccaagagctacctagggacgtgaggaataccaagtagtaatacttgagatcctcgccttttacgtgtgggagcaacctcgtagcagttcggctgacgagggacccatgacggaggcaccacctttttccaaaaa

SEQ ID NO: 2357 - DNA, 736 bp, Rice Picorna-like virus 2
  isolate FYBPH-9, complete genome.2
gtgtccccaaatacgcaccgcgtagcgcttaaactacggtggcccgtcgtaagttgcgcggtggacaggggggacacaggtcagtcccgggttttttaaccgtactactcaggcgggactataaaatatccagagaggaggccaccacccacacgttttatagcggtaagcgtgtggtgtacattccgctgctaataacgataataataccgcttctgcgggatatgtacagcctcgggaaactgaagttgtgtgcgaggagtttgagggccttagcgtcgacgccgatccttctgccacgggcgctactgaatttattcaggaagcgtgcgcggcagtagatgttcttggcaagtactacgcgggcagctccatccacgcaaagcagcaagatttgcagggcctgcgacagtacttttctcggccccggcttgtgggccgaggtactatcaccactggctttaggggtcgcattgcggtcctgaacgtcaacgcctccaacctttttaccactttgttcccgaacggccttgcgcggctcactggtgtctatggggtgcggtttaagatctgctttaagttgcaggttgcctctacccctttccatcagggccttctgtcacttagttggcagtatggctctttgtcaaccagtaccacggtttatcagcgtgcttcgcgcgctgagactgccaccaacattcctcatgtcaggctggatttgtcagaactcact

SEQ ID NO: 2358 - DNA, 736 bp, Canne point virus
  segment 1 RNA-dependent RNA polymerase gene,1R
atctaccaacaaagccatgcttgggaatctcaaaacgtaaccaaagattgagtgatttttctttgcattatactccttctcttttgtgttgtgatggataggcacctactaagtttggcctaaatactcactattccgtccagttttgtaatttcagctccataatctcatattattccacgagggtatgtggcattgtaattgctcatacaaacaagttcctatttttctcttatatcgattttgctgatttaaaatcactatgggcctagagccaacttgctaagatgtccgatccatcagaagatttgcccttagccggtccatcaggagttctccaaggacccgggagattccctagaccattgacccgtcatcatgaatcttttgaagaagaaacaaggcgccgtcttacctccattgaattaagaatcaaaggcctggaggatagagtctccgctcaatccacaatcttgggtgagataaaaagcatgctggaaacactcaccattgcagccaatgtgccgactcactcagtaacatcctatagccaaatccgcagaggccgatcggcgcgcaaaaattagacagccaaaaatttgttcgtaagaactgtcatgatatttggatgtttgctgtattaaaacttccagtcgcatgcacgaagaatggattataccctcctccttccttattatagtgacagttttaacggacaaaaacgagcagagccatt

SEQ ID NO: 2359 - DNA, 737 bp, Picornavirales N_OV_039
  putative non-structural protein1
cacggattttgtccgtgtacgtctcgcttgatagttgagcttcgctcagctcagagttctccatttgattggaggcattcagggattcgtccctgtacgatctgtatcattacctttactgagtaaccagagaaattagactactctctacctttatgttttagtagattttaaaacctaaacgactgtgccgcccctgtggggttagtcagtgtccttgaactgttgttcgagggagtattaggcgatcttgtatcgccatttttgtaaattattatacagacttataatgtctataaacttagaaaacaaacaaaaatacatatgtaaacatagagtcacatacggctgtgttcggcctatagaaccttactgaacttatcataataaagaaacgcgagttttataaaagaatacattcattaatacctgccttaccaggttctttgtgaatatctcaacgccagagagaagtaaagtatgacaacacaagttaatcatgaccaatgatgaggttatcgattacgccctggtgcagggtagtacagataaattgctgtgggagcaccaagtccactccgtgagatcgaccggaaacagttgctgtcttttattcatagtctaacaaaatgaattaaacaacgtatacactcctaacccgtttctatgcactaataaatatcaaatgaattcaatcaaatgatattactggtgctaactaacacaactgtcttaat

SEQ ID NO: 2360 - DNA, 738 bp, Lactuca sativa marnavirus
  strain pt151-mar-11, complete genome.1
ttattgctaggtacccctttaggggggaactaggacattatggtttttgtctgatagcttgagttttctcttgctagtttattcgtaggcatacatggaaatgctcgttagtatctgatctaaccccaccatagtatcgcggcttacgtgtattatgctggcaagtggactgctaaagcgaccaaattcttatgtttacgaatttacgaatgaaccaaattttgttgatcacgtccttttataaagtgacaacggttttcgtaataagggctttaccgtttgtaagtaaaaagctactgttgtttgacacactatgttagggtgtgccgtagaacagtttgcgctttgcgcaattgcatattgaagaaaaaataatcaaataaaaagtttatatttacatttatgttttataccggttgatgaccaaccttcacaatatatcctttaaagaagctaatctttgtgtgttatgttatgaaaaccttgttgatggcgccgttttggcttacagtcactgcaagttattctgttcacactgacatcacatggacagccagatgttttcatttggtatgcaccctcggtctttgttttcataataatatgctttaacggtgtattgtgaggtacctcctcagatagaagtgcagagggctgaacctaacagtaaatttttggtatccttgaccgggagaaataatacgtcatccaagaaccagagaattacgattttacacg

SEQ ID NO: 2361 - DNA, 741 bp, Unknown
  Description of Unknown: Uncultured virus isolate acc_9.16 sequence
ctgaaacctttttctaaccggtcgaaaccctcaaccgcctcggaaacgttgaggttgagtacaggggcgtaaccgtctaggttacgtctccccccagctcttaggttggttagtctgttagcgcaatgccttacttccgcctttgagttacggcagccctaccgggggatacagggttgcttagcccgcgagggtcagtgcttcggcagtcttatgtgggtccctgagtcacataaggcaacgtacaaaagggacatatggagttctcttcgggggtctctatatgttcttatgtactccctatatgaaccttacaacgccaacggttttcattgcccgctttctccccctggagagagatgactatcgaagacggtgtaatggttgctataattagaataagctatacattaaggacttagtattaaacactagggggacgcctctaggagtctccgttcgggcgtgggatgtggtatagcatttcactcggagaggccaaaacagggatcgcctgtgctaacacaaatgtcaactgactgcaacggccatgcttaattgctctcctaggtgggtacagtcgggcccgtcttcaggtgggtcgcctgtccgctattagtatctgaagttacgaagttataattcaaatcgaaaatctttattgcaattcttatttacgaaagcggacgtctagtaaactatcttgggaagcctacgtctggtggtagttgaaaccaaata

SEQ ID NO: 2362 - DNA, 741 bp, Ustilaginoidea virens nonsegmented virus 1
  strain GX-10 fusion1
aggtgttgtcgaagctggccaccagcttcgcagccaagtgtggagggtaccccgttatgctacatacctcctcgaagaccatttgcatgctcctggtcgagtgctgggagttgaagtcgtcgtagtccagcataacgttgtacccctggccgtgtctcaaagctacgaccttctcgcacataccgagcgtgccgtactgccctgggtcgaggaccaccctcctgttcctccacgccttggcaaccagcgacaataggctacgaatgtgtcgagtacccggggcgcggttgctgtggatggttgccctcgcctccacttcgatttggagggtagtcgtgtgggtaggaggggccgcccacgcgcgaaggtaagtgccctgggctaaggcgttccccagtagaacgctcgggcgcggtggcgcccgcggtacctacaagcccgcacacgcgtctgacggattcggcctagtattgccaactaagtcgtcctccccgtagcgcgtgtggcggttaatcgggagagccaggtggagggttatggcgcgcaaacaacacgtcccaggttttaacgttctgggtgcggccttgccacctccttaaccatttaagagactggtgcatggtggtgttcccgtgtcgagcgggcggtcagacacgagctcaggggagtcgaatccccctgagtaacgtggtttatgcgtagcatagctgatacggccgcaggcccactgttactgaatgc

SEQ ID NO: 2363 - DNA, 742 bp, Simian virus 41
  complete genome.1
aatacttcgaggccttgatctcagaatgcaatctctggaagggaaagtggataagattcttgcaacctcggcaaccataacagccttaaagaatgaagtgacaagtctaaaagcaaatgtggccacagttgagggcatgatgactactatgaaaattatggacccaagcactccaactaatgtaccagttgaaaagataagaaagaacctgaaagatactcctgttataatctcagggcccctgagtgagagccacatcactgaagggagtgatatgattgtgcttgatgaattagccaggccttctctaagttccacaaagaagattgtgaggagacctgaacccaagaaggatttaacaggtatgaaattaatgttgatccaactagctaatgactgtatggggaagcctgatcaaaaggcagaaatcgtggcaaaaattcatgcggctactcgtgaggctcagctgttagatatcaagcgcagcatcatcaagtctgcaatataagaaatcttagttgagtacatacctaagacacaacaataattccactacatatatattgaatcgaagtgagcactagggtggataggtcaagggacacatctaggcatcagaaatccgagtcaatctgcactgtccgggtttaagaaaaaaccaagtgtcaagagcatcagataggcacgaacctaacacaccccgagacacaccagccacacacatccgggccgaccagcagcc

SEQ ID NO: 2364 - DNA, 743 bp, Beihai picorna-like virus 59
  strain BHBei77099 hypothetical protein1
gtgggtggcttaggccacgcatagagtttttctagtcatcatttgatgccagtagtagcacttatagtccttaggggctatttagtgtgtttactgagaagtgttacatgtcatgtataatgttgctaaagatgatattgttttaagcacttcgaaattttattgggtatagtagtgcaacgtctactatatcctttctctctaattagagagataaaatcaatatgtccaccttgtactcatttttgagtacatgttaattagtcagtggaggaagaactaaactttgcagagaagaattagtgtttgcaaactaaggaatagctctgcaatttatgcttttaaaaagatgatcggttaattcgccgtcatttcacttcctatatggaagtgttttataagggattgctgtcgtgaaagatatcttgcgtaagaagaacgtgtctaaggggaagaaaaattcatcccctatagttagtaaggaagaaattcgtcagaggaaggctctggaaaaggagcggaaaactaggatagaaagagataaaaccagattgaatgatctggataccgttgtgcataaaaagaaaagtaagaagattgttccctatgagggagatcataataatatcttggatatcccagtgaagcaagatcatgaattcgatgattttctggacaatataccagattcagaattctttgatgagagtgatattccacctgttcataacaacaatgtggat

SEQ ID NO: 2365 - DNA, 744 bp, Wenzhou picorna-like virus 43
  strain WZSBei69573 hypothetical1
ccacggtcctaatcgaccgtgtatccttttgaccccgtgtaggttgcgggtgaacgcctcattttgttaattcgaagttctcgggttttcaactgaggtgttgccagtgtggacttttgtcgcttatgtttcctatacatcgacttgtgtgtataggtacaacaacctccaactttaaccttaacctttatttgagtgtttattttaagatgtctctaactcagctctcttgctgtcatggctaatgactcgtgtgtagattgtattggatgtgcccatcgtgtaacgggccatcacttaccacctaaatattagttactcgtcgtggaggctaatagcatttgggagtgatggttatgatttcgatgggtaactggctgcccgctagtggttccggtcaggcccgattgtagatctatgcatgccttattagtaacaaaatccttgagtggtatcatagggtggagccccagggctccggtgtgaacactgcttgaggtggtcccctaggacatgcaccggggagaggctcctcgaggaaccggtggcgaaggctacaggtgttccaactgtagtcggcgtgagacctagaatttcccttggtggagggcccacattaaaaaccccgtggggcagaaaggcaccatttacaaaccatatgaaaattacaactagtgatatagacgattttgttggtacagagagacctgcgattataattgttgatacaagagttattacaag

SEQ ID NO: 2366 - DNA, 745 bp, Barns Ness breadcrumb sponge aquatic picorna-like virus 3
  isolate1
ccgtataggcattttgcctatacggagattattgagttgtgtggtttaccccacaccggttcattcatttatggactgcagcacatgttgtgagagtatagcatctctcattgacaatatgtgcggatttaacttgtccttaaatggacttctttgtgcgcttttgattgttttagctataaacaatacaaacctttgtaaaagaattgaaaataaaattataaaaataaatttcaatcaatgttgcaagcgaatacttgcgttctttatgtaaaagtttacactgatcagaccaaactaaaattttgacacgatctaagctgtaatctacagcatgtaaagagttcagtttactgctctttatgattattttaatgctattcctgtatagctgtttttatgacaaataggaacttccgaattatacgagaattcacatctcttggtaacgccttcgggtagggaccaaacccctgacgagactctgtagaaagcgtttctctcagtgatgggaagatattgctcttcaatgaattttgaatttgagcgtcttcttgcatctgttgaaactaacttttgcattgaaagtggccgtttttgaccgcggaataacactttatgatttgcatgactaaatctggccttttattacgccagacaaaaagttgcagtgtcgactgttgagaaattttctctgcaggtcaactgcttggaaagttcttcaactcgtcgatgttaacaacat

SEQ ID NO: 2367 - DNA, 746 bp, Marmot picobirnavirus
  clone c328515_g1_i1_libraryA_2739 segment I1
tctaattctatttttattcttagtgttcttctaccttattcaaggcgaaacacccaaactaattagattggtcaaatttacacgtagcacacttcgtttgagtgtgaatatgtgtagaatgatcaagctacagtaacacacaaacatccaaccaatgtcacaactaaggaggtgaatctctagtgacacacaatcagctactctactggcagaacgtagagacaaacagagctaacgtggctcgagagactgaaacgcatcgagcgaacgtcgcacaagagactgagactaatcggtctaacttagcacgagaagctgagacaaatcggtctaacttagcgcgcgaagcggaaacaaatcggcataacaaagtgtccgagcgtgagactgaaaggagtaaccggcagagagagtttctcacaacactgcagcgtcagcaggactggcagctggggctcttaaacgagcagtatcggcgtgacgccttagcggaaacgaaacgatcgaacaaggctaacgaagagctgaaccgactacgaacgtatattgatgagtcgatccggagcgaaacaaaccggattcagtcgttagcgaacactcaagctaactcgatacgtcaggcaactctatctgaaacagtaagatccaatcagaaacaagaagcgttatcagcacagcgcaacgctgaaagtgaacgcgctaacttagcgtctgagtcaattcgagaagcgcagaacgctatcgct

SEQ ID NO: 2368 - DNA, 746 bp, Cragig virus 8
  complete genome.1
ccctgcacacgcgtacgattatttagatctatatctataatatagttacttttaaatgtgaatgtttcattgcaaatttgagagtgacaactcttaaacattgtgatgtaatttgcatattctaagaattatttagtatatatttatttattcgatatttgtgttcggtttgaagagccgtcaacattatatatttttctggaaattcgacacttttatgacttatggtagtaagttgaagatactgtttacagtactaccacgtgaccagcgatggtcttaaaatatatctctttttctacttatcagaatttttcttgaagaaaattcagatatgatgatcataatgattactcagatgcatggcttgccctgtctgttttaccgaatattgataaattattctaccctcatcgactatgaattttacaacgttgccgcttttattaggtaacctcttggttaggttagcgatttgaggatgaagaaattgattatttgaagatgtctttggtattttgatgtattattaacgaaaatgccaccaagcccacccgggtcgaaacggactattgtccttattagacacggggaaccgcagagtcaagggtgatgacactttgaaggagcttgctcctaggtggtcaccatacgtttggaatttattccttattaaaacttgtctcgttagttgaacttataaccctaaaacactcttgtttttggtttatttgttcactcggttc

SEQ ID NO: 2369 - DNA, 746 bp, Beihai narna-like virus 15
  strain BHHZL10358 RNA-dependent RNA1
cttagagggaaatcctgattcatcactgaatcagttccgtgcaacattagttgattccgattaactagcgctgtgctgaacgttaatcgtcgtgtgatctggagagagttaaaatttagactctttggaactaaattctctcttgctgcgacgttatctaaggtaggtgtcctatttaggacaggtacctagggaggcagccccttccaaaaccttaaagagtctagcctgacaactactgagtcatagttgtgacaaagactaagttctttgaaggcgaaaatacctgacttggcaatcacaaaagaataaaccgatcagatccatcggaaggatctaatggttctttcaaatgtgatcgggaagccatccaaacccgtcctgccggtagtaataccaaaggaaaggtggaccttaaaatttcaaaggtgcttgaatcctatgctggttgcataagaatttggcatcagattaattttaaagggtgtttttctttttcagaaaaggcacagatcgcacactttagaaaagtgttcttagggattgagacgagtaagtacccaaaggtatttaaaggtctcctagccgatcgtttttcaattgaattgaatcaggatcgtccagaggtccctatctctggtcatagactattctatccatcttatgatcggaagctattccgatatttaagtggaatttcgaatggtcagagaccaaagacccaacttagactcttctgggactta

SEQ ID NO: 2370 - DNA, 747 bp, Hubei tetragnatha maxillosa virus 2
  strain QTM20713 hypothetical1
actgcgtaggcaaaacctacgcagtttcttttgactcctctcagaggagagggatcaagtaagtcgatgtatcgcattgataaagggtgggctgacatgtaagtcgatgctgtcattacatgtccatcgctttgtttattagttttaagattttcttcgtctccaatttatttttcgaaatatcttcaacaagaaaaattattgttttaattgactgagttcttataagactatgagtttattgtgtatttctctcttatttgaaccctcgtattttatatagatgcattatgtgtatttggattgtctttcttgacgcttttgaaagggtacaggatatttactttctccagttctcgttggaaaggctctttgaatgattgatatatgctgtttcacattgtttcttgcatagtattgtagacataggctcggcacgcattggcacttccgtacagcaactactctacaacgaatatgtatagcgacaatgtaacgttaaccttggtgatgagttggtgataccctcttggttatgtttcagtatatgtttttctttttaaagatgtgtcccgaggccattctttggtttgatggattgatgaaaagaatacagacattttgttgacatttattatatgagcatattatacacacgacgatgtgaaagaacattgacaatatgaaagcatattgactacaggaaagactgttgacaataggaaagactatacatatgactttaca

SEQ ID NO: 2371 - DNA, 748 bp, Sogatella furcifera totivirus 2
  complete genome.1
caaaagtggcgaggcttttgcccgggcacaccgactctacgattgggagttgggtgtgtccggtctctgcactctggactgctcgcaagtctaaacttaattttgggtaggatggcgaaagcgtgtagcctgaaatccgaaactaccctcatattacatctggattacgcaattgtgcacctgagagactataacatgtacccgaacgcgtaagaatactaaaaaccatgtgggagtggcatgtcatgcgaagcatctatcgttggccctctggttggacgtgtttgaagcggggcgagagtgggttagtccggtagggtttagatttcattttttggactggagagtcagtactcacccgaaacaaacatggaaaacttaacaatcaacacacaaagtagggacgcactagtcaacgaagtaagtgttgacttagaggatgagacatcaaggttagttatagatacacttggtgtaagtgtattatacgataaggttgacaccaataggaaaatactttatggaattgggatgattttggtggcgtgcggagcaatttttgggattatggctgggctcctatacgttcaacaccaggatctgacctcttatgcctctcatatggaaacaaaatggattggattgaataacaggataagggaatcggagtccttattagctacagtatgcaagtctgagttcggacagtcatctgtagtatgttcgcggaattcttcttcttttaata

SEQ ID NO: 2372 - DNA, 748 bp, White ash mosaic virus
  replicase, 27 kDa protein, 11 kDa protein,1
gccctgtagtcccttataatctagtaagtaggtaatttagctatagatatatgtttcttccttgtttgaacatgagtatatcagcagttattgacatagtaaataaatcacactttgtaccctgctacccctgcacacaactgccccccgtcattaacggagtaccgggatcagggaagagcacactcctcaaggaattgcttaatctgcataacgtccgcatctacacagccggcataccctacggatgatcccttaagactgaaggcgtactcccactgagtgagttcacaagccgagctaaccatctgtgcatcctcgacgagtaccaacttgccactgataaagaatttgagccattccaggtattggtgggcgaccccttccaaggagctacacaccgtagacctcacttcattgccaccaccagcttcagagtgcccaaagcaatctgcgaacacctcagaagcagagatttccagattgagagtgacaaagaaggtgatctaatcaagggatctccattcaccacagctgttgaaggagagttactgcacttgggccaagtcagcaaggaccttgcacactcacacaacgcttgctcgaaaggtcccacggaagttcaagggcttgaatttgacacagtgaccttgctttaccactcatctgaactatccaatagaatcggattctacgttgcctgcactagagcttgcaagagattgctgttgctctctgatgagcacgt

SEQ ID NO: 2373 - DNA, 750 bp, Solenopsis invicta virus 2
  complete genome.2
atggactccctaccaccgcaactcaatttactaattggtacagtgagaactttgcttcttctgggatatctttccttgcaagtggcggcgcaaattgagtccctggcagtagcagtgtttcgtcctctgttacgccgagtcgggtacaacctgctagactcaatcaggactatgccagcttcgcacagtcatctcccgctaacaatcaaggatttgacccatggggagtgaaggactcgccaattattgatgatgacgaacgtgttcaatctaatttggaaactgagacagaaataccgaatgaagctgaggaagggttatcagagactgttgaggcagttggtgaggttacgactggagttgaggcagctgaggcgaccgctgcggtgtccactccttggaccttgctggctatagccaatcaacaactaggccaagcagttagtacagcacatgtgtcaggattgcaacagcaatcctcggcggattacacggccaatatgcagtctcacggcttgaatgtaggtcttaatgcagatcttattcgtgaacagcagagccagaccatttcgaggcagcaggcaggaggttctattgggtctttgcttgggccccttggaacgttgatcggacaggccattgccggatataactctgtgaaccaagaggatttgaaaacagccgcttctttcaacggctatgttaatccccaaatgagtaacatcgttgcttcgcagacaacatctggtg

SEQ ID NO: 2374 - DNA, 750 bp, Robinvale bee virus 8
  isolate VN1-22 nonstructural polyprotein and1
gaaatatgtatggagtgtcttctttaagacacttcatatgtatgagtaacgattaatttcggttacgacgacctaatggaaggcgtccctttgagaatcatggcgggatgtcaacccccgcgaagcgatagaatgagtcgcgtgattgaaatgagggagaataaaattcttcggtaggttgttgtaatctctatggtctgggaccatattctaagtttttactgcttttttaagaaaaagtttatcgagagcataactcgtgtgaaagcaacatggtgagtctaacatcagtagaaaaatgacaacccctcccctatatgttatgtaagtatatggcagtgtgccattaaaacaaaaataaaaatctgtatattttatatttcgacaaacagtttgtaagacgttagtcttcaaaaattaagaacgcccctgtgtttattcacttgtagacgcaaaattgtttgatctccattttgtcatcagatatgacaagaaaaagacaaagtgctcaacattagtacgtcttgtaatggttttcaccgtcagaaagatattagcaattcgattttccaacctctacgctcctaaaaggactacgttaaaaggaagacgatggtatgttacagctgcagttgcagccgaggacagcctggcaatctagtaagaacaagagagaaaatgatgagtaggttgtaaactcaactagcatatggtagagggcgaagatagctttaccaatccggggctcca

SEQ ID NO: 2375 - DNA, 751 bp, Bremia lactucae associated fusagravirus 1
  isolate DML-A_DN430091
ctgaccagttgtttctccactccggactgcgatctagtcattaagtcctttcacaagccgccgaatcaagtattaggggagctggtgactgggttgactcagggtgcagtgtgccttgcctggtgagatggacacacaagatgtgaccgccactatagggtccatgaggagttaaatcgatttggtgaacccgtgctaaggttcaccgaccttttaattcaggggatgccgaagggtgaaacttggttactatctgtcttgagtggctgcataaccgcatcaagcgagaaactattcaatgggtagatagttttagcatttggattaaccactaaatgcttatgggccggcaaccggaactgccacattagtatcatccttcgggatgggcgcgttggataccgcgcttgaaatggaaacactgcgctcacattagaggtgagcaactacagtcaagctgggtttttagccaattctcggacactgtagtgggagaccacggtggttaagcatcttcggatgcgttcgtgtggataacctgaatggcatcagggtgtgatcaagtctgagcttcctctttgagatgctttaaccttactcaggggacttgtgagctaacgtaggcgagtatagagtagatgcaaactcgtcgaacgtgctttttggttttagaacaccaaggagtggagagactacacccatacgaattcgggaaaccgagttaacgaatagtccagcccaaagggagcct

SEQ ID NO: 2376 - DNA, 751 bp, Picornavirales sp.
  isolate wag054shi1 genomic sequence.1
gattcaatctaatacagccaaacagaccaatcagaccaatcttgattttcagaaaagtttaattgataggggagaaaaatcatttacagataaaggattaccgtcttttctttattgggggggatcaagcgcacaaactccaaattctttaatacagttaggaggacaaaatttctatgaacaatccggtgttaattcgaatctcccatattttacaggaactccatacgctcagtggaaccatgttggcacacctaagatccagcaacaaaaaccttcaccctctagctctcaggcacatgcaggagtgtcagctcagtctggaaagtctccagcctttgtatcttcaactagttcaggaagcgtatcttccggagggacagttagtatcaatgttggaaagcataatttcagcggtcagacagatacgacaggacttggaaatggccgttactctgcagttcctccaccaaccttaacgtacaatagcgttggaatccagaatgctgcaaggactcatgattttgccacgcaatctaatccatctgtgagaagtgcctcccaacagacttgggcccggtttgactcttcaaagtccactcaaacaagtttaacgggctcccagtttatggtcgacaaaggtacccaagccaatcctttcaggtactatgccaaccgttgagttcctaggcaatgccgtcactcacgctaatgcacacaaaatcgagttcttatacgataacgcagaaat

SEQ ID NO: 2377 - DNA, 753 bp, Marburg marburgvirus
  isolate Marburg1
cccggatactacagcacgattacccacccatccacttcgatatgattcaccctcagatcacagcaatcaaccctatttgaatatccaaaccactatttagtatcctattacttgtcactattgtgtgagacaacataagctatcaaataacaatcacgggcaagaactgggcatacgatggtgatttgagagtattgttcagtgctacaaattcttttttcaattgctataatgatacaactacaaatctccgtacacttgccgcaatactgtaattaacactgctgtatctcttcctcaagccatctgatttaactcaataaacatgacttgattcagagaatatgctgaaaatgttattgattgaacttctcaaatggtgcactatcctactgttttactcaacttggtatattgtaacatatcagcggactctccacttttcttcttgtatattctctataagtcatttacttgatagaatgtcaagtctactggttcagagtctcctcactccaatgaatgtaataattaactgttagcttagatgacaacagttatgaggttatataattactcatggtgtaaaatgtaattcttacctctatttcttctgttttccctctcctttataatatgccaattaagaaaaactaaaaatcgaagaatattaaagattttctttaatattcagaaaaggttttttattctcttctttctttttacaaatatattaaaataataattctcaca

SEQ ID NO: 2378 - DNA, 753 bp, Arma picornavirus GZ
  complete genome.1
cccatatctttctgcttattacgacccccaaacccttccttttggattgtacctcatcctgcaaaattcttgtttggttccatatggactttcactaccagatcctttcgatgttccccgcttatttacatatatatcttcaggacgattctgaatatgaacggattttcccttttgctcgactacctgatcgttgcttcaataaattatttatgtatagcacatttgtacaaaattttcttgcagacggagactgggcgaacttgttcttcggcgattttgctgttgctcacagcactagtgaccgaggttatatacatgacattgacaagtacgtccacttttcgtatgataatgaccgctttgctaatactttcccactatttcagcgcactgattatctggattatttatttcatgaaccagttccttataatgtacgaaaactcagaggatggtattgtagtgttcgaaacctatcacatcattttcaggaacatgtcgcacgccatcttagtttggaatggcttgcaattataaaattactaaactctccattacccgtatctttaccgccactgttggcgcttcagatgaacaagtttattgtttatttggagcaaagacagattaaagaaatttgggcacttctgggtatcccccgttttgagtgtgtttatttcggcccgggattttagctccttacgaggaagcttgccgtaaaacttaaatcttattttaaaacacttcaaa

SEQ ID NO: 2379 - DNA, 753 bp, Picornavirales sp.
  isolate RtNn-PicoV/SAX2016 polyprotein gene,1
ggagtgctcaaaatagcagattggtgtgtacgaggcttgtcaacacttgctgcaattgtgtcaatagcaggctctgtgtatttaatctatcgcctctttgctaaagatcaaggtccatattcgggtgcgccgcagagaggtctgaaagccccagttccccgtgtggtgaaagctcagggaccagattatgacttcgccatatctttacagaagcggagtctcttccctgtgacatgcttgaatggtccattcactgctcttggattaaaaggaaagtggattctcctacctcgccactgcaaagtgggggaaaccctggatctagccggaacagaatacaaagtgctagacaatgcagagctagaatgtaatgagggaaagcttgaattgaggtgtgtgaagattgatcgtcctgtggatttccccaacattttgaaaagaataccaaagaaatttgaagaacgccaggattgtgttttgtgtgtgaattctgaaaagtttccagggttgacctgcccagttggcaaaatccaaaattggggtaagttgtgcttgtctggtaatgtgacatgtcgcaccttaaagtacaactacccaactagatcaggccagtgtgggggtgtggtcactaaatgtggtgaaattctgggtgtacacattggtggtgatggacagaatgggtatgctacagctttgtatcaacattattttgatgccctagatgatgctatagagcagggccatatagtggag

SEQ ID NO: 2380 - DNA, 754 bp, Shuangao Bedbug Virus 2
  strain SACC-1 ORF1 (ORF1), glycoprotein1
aaatatctattagtatacatactctatagcctagaaaaaacaatgatcaagaatccttcagtcatcatgtcagagtcagaatggtcatcggaagattcttcatctcttcacacttcctcaactcaatgtgatctaagcccacttcaaaatcaatttttagctatgtctgcaaaaatacagaataacatagatagaattaataatagacctagatttacgcctctgaattctcaggtaatcagaaagtgtttcaacgtaaaactttctagtggtgagcttgaacaggggttaaaggatgacggagaggaatggatgttttactcagcacaagacacagtatcaaagtccattccggtgtatactagaggaaagatctttcctccacttttaaaaggatctattgtcaaaattaaaacagtcgaagtccctgtctcttctgagaaggaacatccctataaaactaaattgaaccctatatcggagcaataacctctacattgatcttccagattgataacaggtgagctctaatggggaaacatgtaacctccgcattgatcagttacctgcttcacatacctgtgcgcctttaacattaaccaaattgcttttctactcctttaattaaaataatttagattttgaaaaactgtaaagcttaaaactcactaaatagaaatctcaatgagatcttaatctgtttatctcaattgatcttctcctgtttttactgccccaatccacatcccctgcc

SEQ ID NO: 2381 - DNA, 756 bp, Picornavirales sp.
  isolate RtMrut-PicoV/JL2014-2 polyprotein gene,1
tttgaaagggggcccctgcagctcatcagctgcagggtcccccggtggactgggtacacttctcgcccccttctggggtgggggtgtggctcagttaaccaccactgggtggctaccagttttcatagaatagccaatcccgtaacatttgccacctaagcatagtttaacctcctacaattggtcgaagccgcttggaataagactgattgtatactgtgagcctgagtattctcttctgtcttccggttgctctacaaccggataagggctgtacctgggcggtcctactcttcacaggagtctgcataggtggctttcacctctggacaatgcactccacacccactcccacactcaagttagtataagttgtgcatgtgaaatgttgtgaacgcgttgggtaggtgtagcgactacaagtgtgccagcggatttcccctggtggtaacaccagcctctgggcccaaaaggcatgtctctgaccgcacttgtacacaatcccagtgatgcccaccgttagtagtgatctagtaatctgcacttctcaactagcaaaccgtgtgcttggaggtgtaggtatggcaggctgaaggatgccctgaaggtacccgcaggtaacgttaagacactgtggatctgatcaggggcccaccggctctccgggtagaagtcttcggaccttgggttaaaaaacgtctaggcctgtcccccagagggatctggggtttcccttataaccccaatactgacaat

SEQ ID NO: 2382 - DNA, 756 bp, Perth bee virus 2
  isolate WA1-14 nonstructural polyprotein gene,1
attaataatacgtatttctttatttgccgtatcctgtacgatactcaggccatgggatggttttcccacaaaaacaatacacaaagttccttaacattcttttgattattttgattctatataacagcttacgtagtactatgtaagtgagctgttattgatttataatttgatttttaaggttgtgcattgacctgagtatagtctaactatacgcaaataatgtgttcatattaaagttggtctttaattagattctaacatcgaatgctttcactttcagatatgaagtctatatgatttatcacacacgttgttatgggtttagcttacgaagtgtgtagagtagtgagattgactattcagtagatcaatcagagcctttacacatgaggtgttttccctattagtagatgtggtcttgaatatatatttcccatcatttccggattttcattaatcggtaggagacaagaaaagacaggttgtgacacctatgagagaacgaacttatgaatcttaatgttagataagtaagttgtcagaagtggacgtaatacaagtcgtatacttatagctgttacctccccctgttaaagatctgatccgtgatcagatttccacattatgtggcgcttagaattatattggcgtgtaattcaagtgacttgtttagtccccgcatatgttaatcttgagagcgtgagaatataattgataaaatacaaaattcaaaaatatttcagatttgacaag

SEQ ID NO: 2383 - DNA, 756 bp, Hubei picorna-like virus 48
  strain spider129651 hypothetical1
tccgatctatgggtcatgcccatgggtctcattttaacggtcggagcaaccgatagataagctctactacgttcatatcagagatactcgcatctagtttttgctacgtgtcagttttctcgaagtatggatctagtaacttatcagctccaaacaccaaacacaccaaacatcaatcataaatcatttaatcgtgagattttactaagtataaatgtccagtagttctactatacggctgtggtggtacgtggttggcgcttaactgtaacaggttcagtaggccacgtgctgctcattacgcactccagcggaaacaatggttaaattgtatagttagagcaaaagatcttagtaaaattggtgatgcaagtctttcattatgttccgggtagcgaacttgataatttgatttagttcggattaccgagttggaccgagttcattgatggaagcaaccgcattggttatattgcgcaagcgaggcatattgtgatttactttctttggtagtactattcttaggatcaagtatcgagagatactcctttggacaactggaaccccgagaagtaaagttgatcaatatcgttttgcaagtgtatgagaccaatgtatgtgttttgacagtttgccgaaactgtccgtcagttataataatggtagtaagaggttgcacgagacgtaaaccttggctacaccctttgactcctttgtaggtgaaaaggagggttttattcattttaaacttaaacc

SEQ ID NO: 2384 - DNA, 757 bp, Beihai picorna-like virus 114
  strain BHZY60932 hypothetical protein1
ctggggggctaaccacctcccattttgatctgcctcttccctgttggtcagatatgaactttttagtcatatctgaaccggaatgcagttttcgtaaaatgtaacgtttaagtgtctttgtatcgttttgtaaatcaaagtcttaatcaatgttaacttagtattttcagtagaaattacgcgatttttgtcaattagtaagaattctataggcgtagccttagaccttattatggcaatttggacagtgttctaccagtcaatactagagttcttagtattagaactataaaataatactatctcttggaagcagagattgaaaataattccaccccttaggcacctgagacccaattcttaggaatccaccgtataggatttaaaataagatactgaagttaatggaagcgacaagcttgcccgagaggtaacctcgctaaacgaccctataaggattcgacccctttatagtacgatttttgccgctatgggacgatcaccggccccgttacttaataccttctatctttcattgttcacaatcttagtttagtcgatcttaaatgtgacgaactatttatattgatacgcagggtaccctctgattgaatctcaccttagtttaagttaagaggactacgcgtaaccagaccgccaatgctggatgcctatcaatacctaattttgtgatcatgtttgaggggaggatctgtgacaactgccaatttgatcataagtggcctcaatatagatc

SEQ ID NO: 2385 - DNA, 759 bp, Picornavirales sp.
  isolate H1_Bulk_30_scaffold_14 RNA-dependent RNA2
ggagattgcaaatacggtgtatgcagatgtaaataaatagctgcatggtaaattgcatacatgacagggcgtctccaggaaacgtagctttttagctttactactcagggccgtttgtccagagaaatgcggctcttactttccttatgaagctaaggttgtgagtattttgcttcgctaacacagataactttacagttgaggcacaagcgtgccgtgaatggaccgctagagtccttgccgctaatcttacttattatagattgcgacgtgagctttttgaacagttcaacgatttagtttttgatgaagaccagagtcaacctttggttaatgttaacgaggaagtgttcatagtagttagacagtttttgacttcacgtaatgatgccattaatgatgataagcgcttgtcttttgacaaggctatttttgagttgaggcgcgcttgcgcaaaggctttaaagtctacaccaccttccacaccttctgagggtgtttcgagtcacgtctctccatgatgtccagagaaatgccgctcgccatttgagtgtgagaccattcagtggcgtataatgtctcgcttcttctaaaaataattctaacgagggaaacctccgtgacgccgacgttaagtgcgacgaaataaattctttggcaattactaattcgccagagacgactggagtgacttcatttgtacaggaggctgtagaatgtcaggatatcattccagaggctgttaaccttggcacttta

SEQ ID NO: 2386 - DNA, 760 bp, Nephila clavipes virus 1
  isolate SC, complete genome.1
gtggtgggtgttcccaccacggtttctaagttttcaatttgaacatttgtttattacattatataagtagtgttgttacgacaacacgctatatttttgtaaggaccatttgtttgaatcttttcttagttatttttcctttgtttacgtttttctgtgttagtgtgtttgtgtttgtttagagcttgtattcactccctttctatgtagtgacaagccaaaaatctactatataaaatacctttcatcaagttagtttcaaatgaattccggtttacggttataggatagttgatatattgtgttattgcaatgagttcgtgaaaaccccttaacagggctaggaagaatggacccccgcttaacgggataagttgtcttctcgttctctctttaagtttgttaatctcactttattatcgctatcacaacttcacgaatagaaagtttcagttgtaggctagatacggaggactcagatatggtgtttgtagaagttcacttggtaattcttgtggatggagactcttcgtgaggtcgccctctatcgctgtctgatgaggttgctagtaacactggaccgagtattgtgtgtcgaagccaatttacgaagtagtttctcggcttttatgaaactatccaggacatgaatcgacagttgctcctatcctgagtatcgatcgatactgaatgagtactgaaggttgaccatttagtttatgatttattgattaagatttaagatttaaagcgatttaaa

SEQ ID NO: 2387 - DNA, 760 bp, Beihai picorna-like virus 44
  strain BHXG26143 hypothetical protein1
gcgggattttctcccgcactcttatttcaccgacgttaatcatagcccttgctatcatcaactttgagtgatatatgttcctattggtagttgtatactatacggtatacccgtttggctgcaattacaatagtgcaagatctatgattgttagccagtagggtgatatctgatcccacaattatcaatacttaatagactttgattcttccagtctataaaattagaatcaacaaacccaaattttatgtagtaatgttttgttttgtcttacaacttataccttgagtttataaaacacacctttgctcgttattataaaaatattattatttatgagaataaaatgtgaaataggttgttctgcaaccacctggttgggctattaccacgcccctgacttaccagtgtttcagtatggagaagcccgggcgatttgccaaagggttatttgtattgaatatcacattaaaattagtacatttgtttaatatatgaaattattggtatcttcgtttagttcccaatagacacttttaagtgagtcgtgcagacgttcgtttttcggagtcaacttgacccaataattttaatatattaaattcgagaagatcaatgctaatttgatgtgagtttcgagaggattgagcacccttgagaaaggttttacatttgaagcttataatgcgatggtaattttatcgatagcagctaaacttcgactttatatgttttaaaaaacttacctttaatcaatgat

SEQ ID NO: 2388 - DNA, 761 bp, Wenzhou picorna-like virus 40
  strain WZFSL83107 hypothetical1
ataaaatgcatgtataatttttattcatatttatatttatgttatgtaacatatatgcttatgaaccgagtaaaatcggtcacggcgtcactatggtaaaataatatatatatagaaaactttttcacgtacatgcgaacaaaaagatttatagtttttcatatagggttgacaaccccatatgtgatggagttttcacaaaactccatatgtttgatgacaaaataataattatttgatgcagtttattaaaagatctaagattgaattgtgattctattttaaactttatatggactaacacggatacgagatttatctcgaaggtatctctggacatcgtataaaacggagagtagaatcttctgataaggactactggcctcaatacaatgtatcacgagcgttgtattgttgtatctcaaccatcacaccactactagtgactagtagagtagtaaaacagtttcgactgaaggctgtgatttttcttttgtggcgcgggtttatacactcgtaaaacaggcttgtttcttttggaagcaaatgggccatcccatgttatgtcataccagagtaggctaacgtacggtgcttgcacactactagctaataccatcggatcttgtatttaagtacctgaggattgagtgtcgttggaaacgatacgagctcaatcataacagactagtaaatatttgatgcctgtattagcataccgaaagcgtaaccaaatgaccaatcatggatcaatgtgaaat

SEQ ID NO: 2389 - DNA, 762 bp, Pythium polare RNA virus 1
  PpRV1-OPU1176 genomic RNA, complete1
ggattttaaagggggtaagacacctttaaaattcgtccgatttgcgcttgtgccgtggtttgatccgatacgttcgtctctccgcttgccgctgccagtctggaaccacggtccggaaagcatgccttctctggaatccaccgctgaggtcctctggttacaaatcggtcggcaggttcgcctgtcagcgtcgtcgaatgagcgaagttgacgcttgcgatctactctgacacccgtaccaccggtacggacgttatgaccctcgtcccgcccgtaaggttctacgttatgagccagttaacggtcttcgccgaaccgtgtacaaatgaggccccggactatccgcctatcggatatgccaaggtgaaagaacctgacaacagagagagagctgtgaccgctgggagagaccgctgacggcagtagatctgcaagcgctaaacggaatccggaccggggcgtgacacttggcaaagctggggagttttcgacgagcttcctattgcaaccttgtggatcgaacagtgttcttagttttccaattaagtgcgattaggattggcccgaggggcgaatgcaccgtatgaaggatacgcgttgggcgtgtattactgtatgggaagaagcagattatggattctctgtgttcgtctaagaaacttggtaactggtcagtcctagcgaggcaagggagtggtggtttagtcgatgagccacctgtgggtaactggaccccttgcgttaccgtcgcattgaaggtga

SEQ ID NO: 2390 - DNA, 763 bp, Soybean leaf-associated negative-stranded RNA virus 2
  isolate1R
ctgctgtcgtagatcgagatggacctctgaagagtggcatgccgaggatgttttactccatcttccggctcagctcaggtgcctcgctcaacccgcttttgatcatcactcgatttgcccgaaagtatccgcagttctatgcggagtttcccgatctcgagaccgagtttcacgccgctgcgcatgcgcttgctcggttctacgacgttaacgagaagcgtcggatgtatctgaaggtaatcttcggaagtgattacgtccctgtgcctcgaactgatgtcgactctcttttgggagttgctgtcttcaccttgcagcaaaccgagcgttctctgcaaaactacaacggcggcaccctcagtgtagctcatcgagagaaacttctctcactcctcaatgtttccgccgcaaaggaggaagacgtcccggagtcctaagtctccttctagtctcgcactgtactgtcattggtgattaaataaaacttaggagagaatcaattcgacgtcgatacgatgctttacgataagtttctgacatatgtcatctccgtcgagctactagcgaatctctgcgagagagctggtatcgaagaatccggaccgaagaaagaagatgttccatctcgatgcgtcttgccgattccttccgtgcctatcgagcatgatgatcgagagagagcaaagttggttgagctaactacctcttcgtcagagcgtctgtaacgcaaatataataaaacttaggagacaaataaatcacc

SEQ ID NO: 2391 - DNA, 764 bp, Ipomoea aquatica botybirnavirus
  strain pt078-rha-1-newwen-plant_78,1
agatgtgtataagagacagagtcccaacccgttccaccgaaggtaggcacaaaaggtgggtgttaccacaccaccggcccctctcagcactagctccatcactggatttgtcgtgtctgctagaccagctccatagcagatggtttgcttattatcccgcattccgcggctggcaataaaaggcgaagcctgtgctttggcttttattgcaagccgcggaatgcgggataataagcaaaccatctgctatggagctggtctagcagacacgacaaatccagtgatggagctagtactgagaggggccggtggtgtggtaacacccaccttttgtgcctaccttcggtggaacgggttgggaattccgtaaggaccccagtaatgtccgtgcgacggggaaaagctacaacagcctgcctgtaacctgtaagggccaagggactacccagagtgtaacgactgcgaatcgtttactcagtatctaggaacagtctacttcccacaactcaattgagtttctggtcgtcgaaagccagagttaaaactgtgggcggtgttcgaccttcacaatcttagtaaccccgatttttgcgatagatcaacttttgaatatcgcccggcagagtgagttaatccaacagccacccatctacataaacaacaaaatatcggaaacacaccagcaccctcgaaactaggcagagcgatttaatccaacagccgcacgctaactattaaaacaacaaaacataccatctgtcaac

SEQ ID NO: 2392 - DNA, 768 bp, Shuangao insect virus 8
  strain insectZJ96360 hypothetical protein2
gttgggataagctccaattctagtttaacccgggatgtgcttttgttgcccgaagattcaatttggtgagccgtaagtcagcccagacaagcgcagtaaccaatgcgaatgaagttctccttgagcgaccgagaaggcgcgcaggtgaagatgtatcacttagtaggggaggttattaaacgaatctgaaaagtagttttaatgaagttgtacttactattgccccacggattgaacggaaagaaaccgtcatacccagtgctgcaggaacagttactagacctttaaaagtaggcgggccaagttactgcagaatagttaattcaacggatttaagatgaaaagtaagaggcagtgaacaccgaagcgaaacgtaaacgagataaaatgaggccagatgcccaagtcgtaagctccaccacaacccagtggaatggagtaaagctcagaagggttctcggatacattagacattagtcgagagtctccctaccgcacttggggaggtaacaaactcttagcctgtgacgttggattgagagcaacataggttataaattaggaaacgctttcaaaattgctctgggcaggattttcaaatcagaacttcctgctttaaataaaagtgcacaaataagtctatatattttatgtcagaagattttgataaggagattttgctatttacaattaaagcttctatagttgttttacttgtttatatttcagctttatctttgatttgtataattgaaaaccgaatttaca

SEQ ID NO: 2393 - DNA, 768 bp, Dicistroviridae sp.
  isolate fcc172dic1 genomic sequence.1
acttataatatcttacgggcctacgtggcctacgctagtacaatgtagtatagcagggacttaaaggtcctttcaaaaccaatataggctcggaaatccgaagtacaccctataccagcatttacgcaggattgcgtaaaggtcaatgaaattaacaataagtatatcgtatacaagagattgtatccacaaaaaaggagccgtaattcctaatgagcagcatatagcgcggtgtgacgcggtgtgcgaagggattataggttcttttttgtggatacaatctcttgtatacgatatacttattgttaatttcattgacctttacgcaatcctgcgtaaatgctggtatagggtgtacttcggatttccgagcctatattggttttgaaaggacctttaagtccctgctatactacattgtactagcgtaggccacgtaggcccgtaagatattataagtattttattatattttattcaccccccacattaaccccagttaaagctttataactataagtaagccgtgccgaaacgttaatcggtcgctagttgcgtaacaactattagtttaattttccaaaatttatttttcacaattcttagttaagattttagcttgccttaagcagtctttatatcttctgtatattattttaaagtttataggagcaaagttcgctttactcgctatagctattttatttattttaggaatattatcacctcgtaattatttaattataacattagctttatctatttata

SEQ ID NO: 2394 - DNA, 768 bp, Beihai picorna-like virus 82
  strain YYSZX17728 hypothetical protein1
cggcataccaacgcacgcccaatgtttgaccctcaagctctggcatttagtctgtttatcttggttaatactcttcggaggggtacaagttcgctgcggctgaaagcgggaagctctgtccttatggggccgaacccttgtcgttatgggggggaacctatgtccttatgtggggaagccttgtccttatggggccgctcttacgagagtgtatctttttgtttttagttttaagtctgcttttagcacttaggtcgtagaaagctagattggcctaagtccttctttctctcttttactattttcctttctttctttctcttatgtagtggtgatctaccttcttcacccgtggataaatacacgttaaactttgagattccattctttcaacttgatgttttgtcatgttcctttagtacgttcggagggtaaaacctctttcgcggaacgagattatgtcatgatgagattgattgttgtctgtttagaatgatgtctgacatactgctgtcagtttgatgaggagttctcataacctctaggcgacttgagattcgcccttgttcattgcaatttgctagtacgtatacgtggttggtctgatcatttgcgcagttcccgtgacaggaactgtgtgtatgtgttcagatgtggagactaaatccaactgctattaggttacgtatcagctcgtcacaattgcttcgttcaagtttgctcgtggggtagtgctatgacccacctgttttgctctcacaacattcg

SEQ ID NO: 2395 - DNA, 768 bp, Hubei picorna-like virus 25
  strain QTM27237 hypothetical protein 11
tatgcctaacggcataccatacagtgtagaggaattttgatatcggcatctctatagaacaagactgcaagccagaaacatgactatagacttaaccgagaagttttcaatttacacaaccccctgggatcaaaccctcttgtctgtccagactttaaatggactcgcctttccaattaggccagacttttgcttttatcgaagtaactatatagatactagcaaaggaaagcggcgtattgtattaacacgaaacgttgtgctgtgttttgtcgaaacaccataataaatcaacaaagacgacctatcgctaacgaataatggacgaagaattcggacttatttactatgacgattaagcgggcgtatatgtttggtattacttaacggttttatcgaccatgttacccgtagttataggaatagacgttttggacttcacctaggatagccctgaccggcttacccgacggattgaacgagacggctatttctatgagcctttagattgacaaacgtgcaagtttttgtcgcatcatattgcgcgctttgcgattttcagtaatggagaaagcaaggacttcgacctgacccgttccacggtacataatctggttatatatattagaacgttagacatgtattatgctaatatatatttcccgggcctgaaaaccctaaagaaccctaaggacgacgatggcaatcgatgagtgatatgacgaggaccgcttcggaggcggacttgtattggcggacgcgttagaa

SEQ ID NO: 2396 - DNA, 769 bp, Shahe picorna-like virus 14
  strain SHWC13617 hypothetical protein1
tatatgattaaaatcgtatttatttattatttagttgttcctttataatttgcagtagtgcttacgttagcactttgcaattttattttggaacattaaatttataagtatttacttttctagtcttatagctctgtttgtgtacctggatgtgggaatacattccaaacaatttcaagggtttttttgaatatcaaaaaccctaatcgagtatcgccgtcaagtcttagcagttttatcgctaaggttactcgttccctcccttttggaggagctctacggtttgacggtcttaatttgtccattttccatttggattttattaagaccttttttgttttagtacactttttctagttttattgttttgctttgcctcttttccattgaggttttagcttgatgatttaatttttcttccctactatttcttttctctttttctacctattctatctctacttctctattgtttagaagacgttgccttttctattgaaaattctttattgcgctcttaaatgacctttatttgaatttaatacatagattttggttttcttattctttccgcaattgtccgcaccttatatgtggggttggttggttttccagaaaccagcgctgtacgagatatctttctcccaattagtgggagtttcaacagcttaagctcgccaaaactattttttacgacggagttcgtactaccctggttttgaaatgaaagtggtggaaaacagccgaaaggcacagggggagaggagtc

SEQ ID NO: 2397 - DNA, 772 bp, Potato leafroll virus
  isolate May8B, complete genome.1
atgggcaagcggcaccgtccgccaaaacaaacggcaactccgacatccccgacgccgctacaagcgcaccaccaatggacagaatggtcgaacagatcatcacggctatggtggggagaatcaatctctcggagatagaggagaagatagtgagcagggtgtctcagaaagccctgcagaagcccaaacaaaagaagcgcggaaggcgtggagggaagaacaagcaaaacagttcacctcctacttcaacgcaatctacaagtggggcgcccaagaaggaggctgccccccaggcttcaggaagtgtgggcacatcccgcgctactaccacccccgcaccagaggcgaaacccagtgggggcaaaaactctgccaagttcatcccgagctggcggagaaaacagcaggattcggctggccaaaagcaggatctgaagctgaactccaaagcctgaatctacaggctgccaggtggctccaacgcgcggagtcggccactatccctggcgcagaagcaagaaagcgcgtgattgagaaaacagtggaggcatacagaaattgtgtaactaacgccccactgtgctcccttaaatccaaactggattgggctggctttcaacaagatatccgtgaagcagtccagtcccttgagctagacgctggtgtaggcattccctatatcgcgtatggcctccccacacaccgaggatgggttgaggaccataagcttctcccagcgctcactcagctgacctttgaccgactacagaag

SEQ ID NO: 2398 - DNA, 773 bp, Guangdong chinese water skink picornavirus
  strain ZGLXR1196821
ggggaaaaccccctacaacttttttcgcgcagttattggaatctgcgtaggcaataacatcgatgtcgctactctgtgcttcggtgcagagcggcctatgtcgcatgttgccaacatcaaaattctgggagagtcgcgaactccttaacactgccttgcctcgacggagccgttgttatagtgtcgacgggatacaaacattaaactaaacccacttgcctcgacggaaccccttaccttttattttattttatagtatgaaagtgaatcttgtatgaatgttcatagaaaactgcaaatgagtaccacgtctaacatgagagaatgatactggagaaatccaagtttagaagtcactacgaatcccagcggaaacaagggaattctgagcttctaataggcgtttaagactatttgcaaaattctggtgcgtaagtgatattttcattgcgtagaacgctggtaaccactccggctagtataagcattgttagtcacttattatgaaactccacactatcctttctggagaagcacacaaacttacatggtaaagctagaccattatcttaagcggtgagtacactgcaaccttgtaacaatgcttgtatgactactttttgtatatcttgagcaatattgttgaggtggacatgtccaaaggtaatgttgttgggaatggaggggtccattttcccgtgcacgtagtgtactagtattgggtgatagccttgcggcggatcaaccatgtattttaatccgttgactttcac

SEQ ID NO: 2399 - DNA, 774 bp, Hosta virus X
  TGB1 (TGB1), TGB2 (TGB2), TGB3 (TGB3), and coat1
gaagaatcagagaccggttctgcccaaaacatatcctcatcaattgcgaaaagaccccaacacaaatctctgactttgtcaaagctcagtgggacttctctgactttgcatacgccaacgacttcacggcctttgaccaaagtcaggatggagccatgctccagtttgagatcatcaaagcaaagtttcacaacattccagaggatataattttaggctacatggacatcaagacaaatgcaaaaatcttcttaggaaccctggccatcatgaggctcacaggcgaaggacccaccttcgacgccaacaccgaatgcaacatcgcgtacacacacttacgattcaacgtgccggaaaatgttgcacaagtgtacgctggagatgattccgccctctcaaaggtctgccctgaaaaagactccttcaagcaattcgcggaccgactcaccctaaaatccaaaccccaggtgttcccgcaaacacagggcgcctgggctgagttttgcgggcttctaatcacaccaagaggaatcataaaggaccccgtgaagctgcacgcctcctgggtgctggcaaccaaacttggcacactgcaacaaatcaaatgcgttaactcgtacggtgaagacctcaagctttcttacgaccttggtgaccatctacaggagctcctctcggagtcccagtgcagaacccaccaagtcaccgttagggagctggttaagttcgctggaaaagtcgaaaagcatcaagcagagatcagatcagtggcca

SEQ ID NO: 2400 - DNA, 775 bp, Wenzhou picorna-like virus 45
  strain WZSBei69068 hypothetical1
gtgaggatgaacctcacatgattcttttatggctcgttgatgagcaatggtttaattaccatttttcaaatgatgcgagttcgcgtgctaatgattagcagtggttttattaccattgccttaatataatttagcataggcggttttgttaccgcttcattatttcatatcaattcattttgtataactttgtgtgtattttctttttgttttaattttgttatgaacgggcttacgctttagccaagctatacgctacggcagtacggtctaatgactagagagactgctagaatttcaattttgaaacaggatgattgtactttcagccaatgatttaaactttttgataaaaagtgcgttacgttaagttgcaaatggtgtctgattcagactttggttggtcggcagaattcttacgaccttaatgcggcacattagctccattgcgggagtttaggccacaatttattgtgtagtgtctatgtaacaagacggtgtgagagatctttgatcgtggctctttgataaaaggcgttttttgcgaggcgtataagatttggattataggagataccaataaaatcataaaaatcggtgggtatcactttaagtagcgagaaagacatgccttcccaaaggcttagtttagggtgctgcttacactcgcaagtgtatttgcattatcttgtggatatttaagtggacttaagtattcgtgggaacaagataatggcttgtactacctcggtaagtttccgatgacgcgacgacg

SEQ ID NO: 2401 - DNA, 776 bp, Picornavirales sp.
  isolate H4_Rhizo_44_scaffold_11 hypothetical2R
atttggtagcccaaatatatatagtttattatctaaatgctttgtgcaatatagcacggcatccgatctattatggttgtgtcaatatttgacgctcactatttgttattacaatggaattgaccggattttccggcactattgtatatcaaatatgagtagagacaatgagacacttcgactgtattagtcgatgttagagagtttgagctctagtatttagatttaatctatagcatagattatttctgatggccctgattcgtggcattaataaaattaccaatcgccccccctgcatattacaagaaagtaaatcagtttttaactggcattattaaatcgtgtatccttttggaataaatccgtacaaataatgtttttacacaaaataacagaaaaatagataaaagtgtccaaacaaaaacatatacatatatatatacatttgacacagaacacacaatttttgtgtaggtttatggaatagttttcactgtcgaaagctattagcaaacatcgcaaacgcctctccaaatcgaatcacttatgtggtgtctgaagatttgacgcgaatcgtaaagatgtggtatagtacagtaacagttgttaccgaggctagcctagcaagttagtagaccataaactaaccttcttttgttacagcatcatgtaagagtcaagatgcagatttctatatctttaaatagaatatctctatactgggagaaaactacgtcaccaaaatccagatacaacagacaatttacacgata

SEQ ID NO: 2402 - DNA, 777 bp, Iflaviridae sp.
  isolate ecw123ifl1 genomic sequence.1
tttaaatctagtgcataacatcgcactagttatattttggagataagtaccataatatatttaaagtttgcattgctttcaatcgtgaaacattccttcagaattatttcatgctattaaccgatgagccgtgagtaagccctacaagcgcagtaaaaggtttttagaaagagttttcctttagtaaaaaggagacggtacgattataaaataataccttccgcatttattagcaatgccgaggtggagaagtaaagtggaaagttaatttgatactagtaataatgaaaaaaataattatgtaaaagtgggaatgaggctaaagattgccaataccccatgatcattcgcccagctaggcatgtaccgagctattagaaagaataattataataaataaatattagaagatgattaataagtactaatgaacgcccatggaagacccttttaaagggagatatattatcgatcatttagttaactcaaaaataagcggtttggaggactttaagcctataactcctagagcatctatttgtggaaagtgcagtgcgcatataattatatccgttgtattatttaaacagtcccattacatcgtgctggtgtgggatagcagctggtaattgatatttgatcctaatgaacttggtattttatttggactacttttcaaaacattgggcaggaattttaaatcaaaaactcctgctttaaaatcagcacaaacaaataaataaatacttaaaactttagaacatttcaattttaaat

SEQ ID NO: 2403 - DNA, 777 bp, Beihai paphia shell virus 4
  strain BWBFG40859 hypothetical protein1
caggggcactccccctgcacttcctattttaacttcatatgagacgtggttactccatatgtcgtagtgatgtaagtttgctgtatgattgcgaacaccgtaatgtgcggtagaacctctctcacaaaacaaccaagaaccacggtgatactacccgtgttaattgtagtacaaccccaaccaaccccaacctgttagcttaaacagtataaacctcgagcaactcgtgttaactaacgtagcgatattatcttatgttattttagtcaacaacttctttagtgttgagtcctagaagtaaaacaacactcaacttcattcctttgtattagttattcaggatcacctagaattatcgacgtaatcttttattttatatgtctacaaatattgatatggaaaatatgggacgctttcggtttccaatggtgagattcggatactcactgcggaggttggataacttaaagttttctgaagcttaggttcttatcactgtttatatatcttatatattcgtcggagctctgcctttcgtattctccctcagatatggtatgaaaatagactatgtcaattcatattcctctactgtgaaaatatataagtgtataatacatattccctaacacagatttagtcaccccattctttattagtaatcaacatataaatattagattcaaccgtataagacttggtgttgaatgaatcactttacttagatagtaatgaggccaaggtaagagctttaatcttccaacagaaacaaacaaa

SEQ ID NO: 2404 - DNA, 778 bp, Neofusicoccum parvum chrysovirus 1
  isolate CREA-VE-22AS3 segment1
gaaaaaggcttctcatttttgcacatgtacgagcgctctccactaaacacgttaggcacaccaggtaacgcccaagacccaacagctagctaactgcccaccacaacgccccactcccacgcggccgctatgagcaacagggtgccacgtggtttcgctcacatattctccgacttggataccgcgagcgcttgggacaacgcactgagcgaggttgaagaacgcgagccggacgagagcgtggttattgagggcgaccccgagatctacgagacactgcgcagtcacggaggcccgccgcccgactacgaaactagtgagatagctagcgtgtacggccaaagagcagccccacccccgccagtggctgggtgcgcccgcaaccgctttgcccgcaccgagcgccccgcaaaccaccgcgaagcgccgcagaggttggctacaccacctcctcgcccccgtcgagacactcagttctacagttcggactggccggggcgcgacgctctacccacacgaggcggcatcgaggaacagacggcgcgcgttgaggcaaggaaccggtggctgcaggctgaattggacctattaacagaggacgacctgcggttcaacaacacacagcacagagcgcgtgccccatccgtacgcagagagtccggattataccaacgcgtgagcgagacagctgctcgagaccggcgccagcgcgaacgccagcgtagcaaccgagggagtagcaccaacggctctggcagcacactcgtgcggtacggcg

SEQ ID NO: 2405 - DNA, 779 bp, Cylindrotheca closterium
  RNA virus KT12RNAV genomic RNA, complete1
tcctgcattgaccacatgcagggtttttcgggtattagccgttcttaattgaacgcaaatatttcgtttatttacgctatgaactccaacgacctggagttatttttgaactgcgtaagtaacgcagtttgatcaaaatatagtttagatttaacatttcgaagttttttagccgacatttttatgtcgtggtaggcaaaccattgccggtgacagaaatcccattgatatagtcacttaaataaaaccgttccttttaggaatgtgagcatttcagatttgggcagtgaatggggccccaaatcagtcgcacaattgcggcattacgttttaacgtttatcgtagtcaaaacgttgatttttacttagtttgattgtaaaactaatgtgtgttacgaaagaaagtcgactcactgatgagtttattgtgttccttagttggttacgctttaggtggtttgccaatcccacctttagttctcatttgagatataggaagacagtgaatgaattattagtaacgtaagtacgtccatttttgtggagcacgtgtaggtcggtaccgtatgggtaaaaccgttaacctgatcgtgtaaaacattgatgacacatgaagagacaagatttctatttagagatagggaagccaaacccgcacaaaaaatagagcaaaggtgcaatctacgagcctaatgtatttatacaaaccgtgagtccactaaccgaaagtatttacaggatcaaaacgagtttacagtggaaatttggtaatcaggaat

SEQ ID NO: 2406 - DNA, 779 bp, Guangdong fish caecilians picornavirus
  strain GDYYC830051
gggatttatccccatgctgaatttatcccactctaaatattagagtgttgtactcctctttggcccaccattgtacggggtgtgtaccgtacactagttatagtaagtaccactagttcttggttccttctcgtgttagtgcacacgttcttgcgctaagttttctaacttttctttgtctaaactttaaatatgtgcttcttttaacctggaggtctatcgtatttgtggagaaaagctattctaagcaaggaaaacaataacactttctatcttctttgtttctgggttgtcctcttaaccaagctggtcccatgggggcgtgggtaaatggccctatggattagccatagtggttatgtaggcgaaataaggggaacccccaatcatgttgtacgttgagttgttcatggtaactgctttatatacatatctataattgcccataagaggtaggctacgggtgaaacctctattgtagacggtaaggctgcggtaaagattttctttcaacgcagggggaccgctgttctgcagtgggaatatataaatatttatgtactgtgggtggatgactaggctaaggcttgattgtttaggggtgcttaggaagttattagaggaaggggttcacttatatgaaattgaaaaaggatgaacgctatcccacctcaaacttcctgagccttttcttggctctttcaggttttaaatccccaaatgattaaaatatatgatatagatacaaatattggtttttgttttgctgattagtagca

SEQ ID NO: 2407 - DNA, 779 bp, Wenzhou picorna-like virus 5
  strain WZSLuoI84329 hypothetical1
acgcattatgcgtatgcggggatcatcgagatgccggattaacttccggccagttggccttgaggaggtcagcctcctttcgagctagagtagcactttgggggttcgccccctctgtgctagttttgttttgtaattaaatttattcttttatgcaggtatcgaccgtgttaaaccagcggtcatcgacctgagaaggtcattaaatatatctaccaatcttttgtgatagagacgtaaaataaacctataaaaataaattgcgtccaatgtattgttattttgtcggtctgtagccggcactatatgttgtatgttaatcacaggctttttactgatcaaatggaagcctaatatgtccattagaactaatccgtaattaacggtaatatgagtattatgactgctcgtctaacagtcatagctccgcctgagagtgcaacgtaatgcaatcaggcttgagtcgggacgaattatcccgaccacatttgaggaacgccttcgggtagggcctcaaccccagacgagactcagtagcaagcgtaatgtgagttgtgcttaggtatagcctcattcatgaatttggattttgagcgcctttgtgcaacagcattgctaacttgtggattgagggtggccattgtgtccatggaataacacccaatgatgtccttgattaaatttcattcgtgagactaaagatgctgtgtcgactgtcgaagatttattctttgcaggacacctgcacggaataatctttgactcgtcgttcaataacc

SEQ ID NO: 2408 - DNA, 780 bp, Hubei picorna-like virus 33
  strain QTM27281 hypothetical protein1
gcaggtttccctcacacggaaacctgcgcacgcgtattaaacaaccattgcatctgcaatcacgtcttagcattgctagtaagttgctttaaacttgctagttgtcctttgactagttgtatgatccgatggactttaatatataatttaattatatattttaccggattaatggtacgacttggaccgtgtgaagtaaacagcttcgcacgttttcttggatttaaccatcgatttataggatggtcactgatgtatatcagttattttcttataaattgattcttgagcgagttttcttttaaaactgcatgcgaagcaatttattgtttcgtagattcgaggtgacattgatcgtttgacctaataaggcgactgaaaaaccaccggcttattagttagatcttggatgttgcttatgtaccgcaggggtcttatccgccccctcctgtaagctactgcacgggtagactggtgtctccttttaatattgtttcagacccatgcgagtcgagtattagaaggctgatcttccggcgactgtgtagatggagctaatgaggatggcttactctcctcgtcatcggaacctaattgctgggacgtcatcaaatacttgggcgatccagttcttgagcggcattattcgcacaggtgaaaaagtcctgctggtctagtgctagtgtgcctcgctcgaatctctgacaaggtagtctttatggttatctataggagttcgggaattagggtgtgaacgagaactaaatttcattttttacg

SEQ ID NO: 2409 - DNA, 780 bp, Beihai sipunculid worm virus 3
  strain BHZC37455 hypothetical1
ataggacatcctttacggatgtcctataggctcttttcttatgtcgatctacagtttgaactgctgtagcagtcgcatgagatgtattcatgctatcagttaatttgactttattaatagttgcgctcttctgggacactatttttattgtccctttagagattgctatatgaagtcctcttggacactcatttgcattgtccaattgtttaacgctagtattactttattctcgttggcagagtactgccattataagttttgaagcttagttcacttcatgaaaggctttctttcaaaaaccctttcaacccccccttttgggggcttacatgttcaaatctttcgttcggggaaagatttattgtttgctcccggcttcctctaattgattttagtgaaagctgatttatttgatgtaattcgcttagtgttttatgccctaaagagaatcccacctttactatctaacaaccgtttaataacctcgtgacctaataagaacgtggaacgagtaggaatgatttagtttaggaagaattggtctcttggagtataatttatcagacgtacttgaacatatttagctcaataccaaatagtaaccttacgtttaagcacgtgaaccacacgtgtagggtatgtagccgtgcccgatatttgagtaagaagtgctatttgtgagatacatataatgatatttcagttattaactttttgatattttaggaagttttgtttaggcctggtgcctaccgaaacctcacccagtttctaatt

SEQ ID NO: 2410 - DNA, 781 bp, Culex negev-like virus 1
  strain mosWSX37710, complete genome.1
ctggcgacaaatgtcacaggtgcgttcgtggaagacgtaaaatctctaatagattattatatcgctagggctaattttactaacactaccatagattacgataagttgagcgaagttctatcgaatgtaaaaattaacgtaaccactacgcagtctaaaccgtcgttttcttactaccgccggcttatagattactatatcgaccacgactacaatatcacacaccatatttttggtggcggttctatagttggtgataggactaaaaggtttacgttcgctggattgttcgagagctccattcttgccatagttagaccgattttacatataatacacgaatttttcttggaatttattgaacccttattagaacgtttgatagatatattcgcaaaaataacattaccattagttaaaacaatatttactttttcaaaaactttgttcgaacacatatacaattacataatcgaaaacgtacctgaacagacattgatagactttttcgaaagatttttaaaatttttatacagaatattgcatgttgttgttgaaaaatttgtagacattctaataaacactaacactacacataaaatttttgagtttgttgcactatatttaattctgttttactattttaaagcatatttcttatcattaattatcacaatagtaacttttgtaatcattggcatagaacgcaccgacgaacataccataatggttatattaatttttacttttctattgattcgctgctacactaacccacgaa

SEQ ID NO: 2411 - DNA, 781 bp, Beihai weivirus-like virus 21
  strain BHZY60786 RNA-dependent RNA1
tgacgttgctttcgggcgacgaggtaccgtgcgcgacggtaggacagctgccccggcggccgtaggatacaaggttggcgtctgttcagtatgaggtgaaaccatggatgtctaagacattgcattggtactcctgcggatggcacttgattccgaaaaccggcgtggggactttttgggcgcatgctgtgggcaggcatgtgagtagtgggcgctcgtggttttttctcagctctggtgtcgcaaccaccaccagcatattctgttaaacagtgtgctgtgtgtccgtgccatagtgtagagctgacccgtgctgtagggctgcattatggtatacgtgagagtgtaaaatagggaggccagtccctgcccgccaaattaccttccgtggtcaacccagcctcgaggggagaccctgagccaattcgtggacctgctgcggccaggttgaaggtgaaggccacccgactccgaatgccaacggaaaacagtcgggcatcctaccagcctatctggatgaacctgatgccccgcacgagagtgtactttaggggataggggagctggaggatggaggttacggttccgtgtcatgaagtgtggaagcgatgcatggcacgtaggcatccagaggccgtgggcggtcattgtgatcatggggtcactgagtaccgctcgcgaattttcatccacgttagcatcacattgtcgcgcagaggaagagtcccagtggtgttgatgtgtgagacgtttgtgtcggtgtttgccattcattacagag

SEQ ID NO: 2412 - DNA, 782 bp, Mirafiori lettuce big-vein virus
  isolate F_Meta-contig11655-RC1
aaaaggaaaaaacattgcatcaaaacagtaaaaacattcagtcacttcaaattttgactatggactataacaaagatctaccagaaaatgtaagaacagtgactaaaggtgaaagtaatgaagcagaaacggttagcaaggctgattgtgaaaagtctaatagtcttagcattcaattgttcctcaattatcatgttaaagagattacagttaatgattcaaaaatacaaacaagaaatatctatcttttaaacttgttaaagggatatcaaactagttacaaagaagtaacaagattcctgttcggttcttggttacttttcgaagaggagctgcagccaccctttaacataaaagccatgataataattgacacgaaccaagaattagtagacgtctcagaatacaaaggaatcgagctaattctagggaatgacatacaatcgtgtattgattcattttatatgcatatttacaaggaagatctaattatctttaatgaatcaggagactttatgttcctgacagatcattttaagattccaaaatattttgcaagactggatggacaacaaataaaagtcaggaaaattattgaaaaaagatatttagaagtatctaaagggaaaacactcaaggagagaacttagctgttttaataaaaaatcaaacaaaacaagtgagaactacaaccaagatcaattaagcaagtaaaaatagtgatatcaaaacaaaaaccaaccttcaagttctttgtcatactcctctgcataacgttaata

SEQ ID NO: 2413 - DNA, 782 bp, Wenzhou picorna-like virus 50
  strain WZSLuoI83448 hypothetical2
atattgcatttggtcctgggatgacattaaactcatccaaactccggaaccatctgtagtataagtttaaaatggttgtgttgtattggataccatatgtgttgaatttttgatgttattttgtacatatataggcttgcatcacatagacattctcccagtgggaatacctgtttttacaggaggtctcgtcaaccacacaaatatcatgcggaaagtgctttgagtagagcacttatcctaagttcataaaattacttactacacttaatactaataccaaaattgaagcggaaggaggctccgcataccaagtctccaaaacctctcgcgattcgaaggcgcagacagtcaactttgttgatggcgatacgccttggtcgtatgatattgtcgcaactcctgacgcgacgaccaagctctctggattctctgatgccgaactcggtgacttccttagccgacctatcaagatcaaggaatatcagtggacgcctggatcttctttgtcagttacgcgtttcagtccgtggacggaattttttagtaatgctgatgttcttgataaaattaatcgttatcgtaacttgcgctgtaatttgcgcctaaaagttctcgttaacggaaacagtttttattatggacgtgcattgctaacatacaatccgtacattgccaatgatcaagtgactgtcaatcgtgcatttattgctcaagatttgattcaagcgtctcagaagccacatttgttgttagatcctacaacttcacaaggtggtgag

SEQ ID NO: 2414 - DNA, 782 bp, Wuhan insect virus 20
  strain WHCCII13322 hypothetical protein 1,2
tttagctaggatagttagatagcataactatgaatagatcaggaaatagacgtggtaataatggatctgtgcggttaccagcacaaattttggccagagcgctgacgcaacaaatgaacaacaagtcagcaagaaaaccccgtcctcccaaaagtaggcgaaaacagccgattgcacctggcaatcgagggcttcgtgacaccttcgtgttcacggttgattcactgaaaggcaattctgaagggaccttaacttttggtcctagccttaaggagtgtcctgctttttctgggggagtgacgaaggggtaccacgagttcaaagtggtttgggttaggttcaccttcatttctgaagctgcctcaacctcctctgggtcaatggcatatgagatagatccacatttgaagttgacaaaactgtcctccaccgtttttaaattcggaataacaaaaggaggatcaagaacctaccgagcctcgcagatcaatggcaatgaatgggtatccacttcggatgaccaattcaggtttctgtacaagggcaatggagacacaactacagctggtagttggcaagtgacaatgatggtccatttccagaactccaaataggtagacgacgacccggcacctgctccggtgccacctccatctccacccccctccccctcacctagtccacaaccaacaccagatgatgagagattcattgtttacactggtgttgcaacaactcgcataagagcaaagacaaccgatgatgcattaattctcaacccg

SEQ ID NO: 2415 - DNA, 783 bp, Nilaparvata lugens honeydew virus-3
  genomic RNA, complete genome,1
tattttatacccccatgcttcatggcagatgcatacagtggagatgcatccctgtcaaagcataccctcttttagttataagattttattattattatcaaattaggcctaagtataatataataaaatgctcgttactgaacggggctcttttgagtgtataaaaatttggttagaatgtaagtttgatgactccatcactcgcggagttatatatgaattaaagaatgtatgggcattccctcacaaatatgaaacatgaccctataattatatcgggaagtactcctatggcgtttatgttgctacttactgtatacatatttcggcattagttgtcaccatgcaagattctgtcctctattatgcatttgtataggccatccgacttgtcgcctaaactatacagatgtgtattatgataatgtttcgagtactagaactacttattagttattccatatatgcataatcatggtattaattgtgagattcatatattttgcgtcagtcgacacatggtgttttataaaatggggttgcattgtaaacatttcaccgtcttcgtcgatcattccatatttttttttaaagctcaaactcttctctttatctatcttttcggagtggcgcccgagatttataatctcattaaattgagagtaaattgagccattttgtatttcctttcttttcttccgtaaaatgtttagctactccgaccaccagggataggtcgatcatccacccccaagaattacgaatcagatacaactaaatacg

SEQ ID NO: 2416 - DNA, 783 bp, Hubei tetragnatha maxillosa virus 3
  strain SSZZ2994 hypothetical1
ggggcttttcccccatggctctcattttaacggcaaagataatcatgccgatagttaagctctcagtgatcttagatgtgcatttggtatacttagtttcgacttttatgcttcttgtacaatctattacactgttggtttttcatgatttcaccctttaagttgaaaaacttattttgattttgattttcgaatttagaagtaagacccctttgtttgacttaacttttgttattttgacattgggcaatccactgacttttgagaatcaccccttgtggttagaagaccacgtacgtaactttagcatagatccttggatagctagttacggcgacgaagtctacttacactttaatttactaagcagagagaaagtgctgacaaattgatttagttcgatttgtcggaattgccgaggtccctcacagaaacccgcctctttagtattttatttgttgtagtagcaggctttgacgatgaactgatataagtacaaactgatcctttggtcggaccccgttcacaagtcttggaacaacacatcgcgaggtgtgccttggccggtaatcatcgctatggttacccgtggacaattgggccccccggctgcgctagcaagcaggaggaacatatcaggaattcaacgaagtatcttttacctgcgttttaataagaaatgcaggagttgataaatagggcttaaactggaagcgagactgcagcggctaaagcagcagtaaatggtgccagtgtaggtgttttctctttttaaatctcatt

SEQ ID NO: 2417 - DNA, 784 bp, Shahe arthropod virus 1
  strain SHWC0209c12762 hypothetical protein1
gctcttccgatctggggaaacccccctgttctcttttgaaagctgaagtattggattttgcgtgatttattgagttaccgcagtttcatctgaatttattccggattttgcaaaatgttcttttgtttaattgataccagcgggattttatctaacgaatctagccacacttttaatcattagcactctttagtacaacggcaccaaccaacccccccttttatcattttaatattcttctgtgacaggcgccttagcgcagtcagtgtttgaggattctttatccatttcggaccgcgttatctatttatagatcctttttacgatttcacactgattgtttttaacaaccatcacccttatatttacgtgtacaaaaaattataaaaacgtcgcaagacaccaaaaacaactgtcttttcatacattagatgcaataataacactgatgaattagactatgaatcagatttacctatatgatactaaaacgtcgccgaggcataaagagcggacccaaaaggaaaacctacgtcaagtattatatctgctgatcagccatcttttttattttgtgcgctgtttttgcggacactttgtaaatgctatgtcgttgctgggctcacttttcgagcaataattactagaacccaaaaaatgaataaaggtcttacgggtattcttaggcagcaactttcattgtcaatccaaacatgtttcggtgtttggttctagcaattaatccttcccacgattcctattttaactctttttaacattcacg

SEQ ID NO: 2418 - DNA, 786 bp, Trichoderma asperellum hypovirus 1
  strain TaHv1CBS 131938, complete1
gggttccgactaaggtgctgtttacagcttaatcgggtgaacgcgcccaacttcaatgggtcaccaatttgggttcgtgatgttcgaaccattggaggttaaatattttgcgttcgtgtcacattgtgacgtgacctatttaggtcgtagggtgagtccctgtggtccattaggacggtgcctctcttggggcgttgcacgaggtgcagcatatcaaaagtaaaatcaccaaaaacaatttaaaatatgaaatgataaaatttgacctgggacgtcattaaactcacggcctcaattgccaccgctcatcggtctcagtgaaggggtgaaagcggccacggtcgttagtaaatataactgggaatgagtaggagagtctgggcccgattaccagttggctgatattaagcggatagattttaaaggttcacctccaggctcaatcggactgagatccgttgtcggcagtaatgagtgcaactcacaattctggctaggtaagacgaaaagacgttaaaacctgaggtgttcgatcaactttaagactatttcggttaaatatggctgggtgggaaaggtagtaagctacccaaaaccttaggctgagatgtcactttgtgtccggtaaaactccggggaagcggaaaaatgcacgctgcacatgacacgagagacacttgactgtactttggtcccgaacgggagcacatgggggtcgatgacaattgggaaagaccaattgacttggcagtggaaagaactgctattcaccatgatcacatataa

SEQ ID NO: 2419 - DNA, 786 bp, Mobovirus A
  isolate MBOVA, complete genome.1
acatgggcgtttataacgccctaccagtcctctttgaacgtgtgctgtccatctatcagcgcaccatggtctcacgaccatgttgttcaataggtattctaatccaatccctattctcccacaaaccttcttgtaactctgttaagccttttacatccatgtaatttaattttctccacctaaaaggatttcccccatggtcctttttggctcgaacaaatgctacatagggtcttgttttctccccctggctctcttgccagggttccataccccaattcctctatttccatgatttttcatcatggtttatttttactgtcttcttattttctgaggtgaccaactcctaagccgactgggtcgcggaagcccggactcctcgcatcactagggtgcgtagcgatgtaggcgaaaatattggttgctagatgcatacatatagtgaattgatactacaccaaactctgttctttttgaaactagctattttctaagtaaggtaggctacgggtgaaaccttaccattgcaggtacgtgaaccgcaacggacatttggccgaagactggtgtacccacgtcagttataggacctcttcaacgttggtggacggcatgtcactgattagttaggctagtgaatttaagttcagggggtatcttttagcttaagcgtgtattctagtaggacttgcagagcctccccacctaggaggatctctgtttatagccccttttccttgttccgttagttttccacacttttacaatatttgatgatttgtt

SEQ ID NO: 2420 - DNA, 788 bp, Bovine torovirus
  isolate BToV-China/BToV yak-XZ01/2019, complete1
tgacgtattcttagttgattttgaagccttgaaataaagcttttaaaccccttttacggtttgtccaccatacggacattgttcagaccgcagtgtcttgtcaaggaggttcagccttgacattacttctctgtgaggaatctactcagaaatactgcttgcgtactagtagttacaagagttgacacttagtacttacaagcgggttcaaccgccctccggaacggtggaaactccctcccgaacgtgcgcttgacgtgaccaatttaggtctagctttctgagaaatactccagggctgtatttgaccacatctgttattcatttgtggttgtccacaaccaaacatcgtgtgactcacctccagctttgctgcaggccttttggactaaacgagtcgcacgttttgtgactagttttaggacttttcacactcccctaccgccaacctgattcttttcatccttaagttttgcgtttatacgctattttcttacggttggcagtttgtttggttgtttgcacagtttcttttaataccaatttttactgtgctcttagtttttacagctaaggctgttttttatttactcaagttgcttgaagcagcttttacaacactagttttagttttaattgaaaagttaaagggcgtcaggaaacaacgcagacgcccttcttgtggtgtctagttagtcctaatctggcaaacaaatatcaggttgttgactccctttggagtgagacctacgagtatcagtttgcttattttggacacccatataaaa

SEQ ID NO: 2421 - DNA, 789 bp, Picornavirales sp.
  isolate muf160shi3 genomic sequence.2
tttagtgttgatgggcttggccgcaggtgcttcagcaattggcactgcggtcaatgctggtatggctgctaggggacagaataaagctattgaccaacaaacttcagtcaataacacaaatttgcagatgcagaaaaacgctatgaattatcaaactctaaattggcaacgtaatgtagatctgtttaaacagagtggattacctggttggatggcggaaacccaaggtggaggtagtggtaatgttgcgtttaacgatttccctaaaataactcaacaagtagctggtaataatttctcttcagcagcaatacctggaaatttagtgagcgattttggcaattctatgatgcaacaagtgatgggtatcgctaattaccagtacatgacaaaacaaggttttggtccaaaagtatctaccatgtcacaaacagatcgcggtgacattaatcctaccagcacattttcgacccaaacagagccaaatcctactgggacctcgatgactgcgactccaaacacccctgaagaactttggggtgatctgggaggcacagtgcctagtacatcctcaacagtagctatgcccgatgcgtctgcagccgctgaggcgattccagctgcagcgccgattgaagaatagccctagtaaacgtgttacttgtgaaaaacatccgcggattttttcacgatggtacagttgtcaaaataaatacatgggcttgaaagacttgaggatttactttgaccttttgtgtttcttggataataaccttgaaatattcaaag

SEQ ID NO: 2422 - DNA, 789 bp, Pearces Creek picornavirus
  isolate A888, complete genome.1
acccctggggcccacgcggcgccagtactctggttcgcttagaacctttgtacgcctgttttccctcccctaaataaattaagatcaccactactgtggggagtagtccgactccgcaccgatacgtcgcaccagtgaactggttcgcttaggacctttacacggagtagatggtgttcccttcccccgtaacttagaagcatgaaccaaccgaccaatagtggcgttgcatccagcagcgcagcggtcaagcacttctgtttccccggcgcgaagcgtcgttacccgcccagcctactgcgggaagcctagtagcaccccaattgatcgcgcggttgcgttcagccacaaccccagtggtagctctgaggaatggagctcgccgtccccccacagcaatgtggtggcttgctcgcgcgtgtcctcgggttcactcaaagagtgttcaccgcaacatcaagtaaggtgtgaagagcctactgcgctaggctggttttcctccggagccgtgaatgctgctaatcccaacctccgagcgtgtgcgcacaatccagtgttgctacgtcgtaacgcgtaagtcggaggcggaacagactactttcggtactccgtgtttccttattttgtttcaatattttatggtgacattgactgatatctgtgaatttgctcgctgcccctgaatattgccttatattacttaatagcatttcacgaaaacgacccagctttcaattgagcttattaactttgctgtatctttaaaccagatccacaagtcggtgtaca

SEQ ID NO: 2423 - DNA, 790 bp, Beihai sesarmid crab virus 1
  strain SCJXSX39422 hypothetical1
cagaataatagctacctgcaagtcattattgacttgcaggtagtattttatgtaattgtgcctatgtttatgcatggttctacggacctatgtttatgcatggtcaccaaacatttattattctgggagaaggatactcctccacattatgtggtaaaaaaccaaatcacggcgtttaaaggcctgaattgcttttagcccactccctttctatggagtgaccaaaacggcggtagggtagagattatatctccctagtccgcgtctttgctgaatattgattcagaaaggaatggcaattcattgtgatgaagttttaggacagactttaaaatgtcctcgtgtgttatgttatatgataagagcagtaccagattttctgctctacatttgctctatgatttttcataacatatcgtctttaagattgtactttattgattagtttttgctggtttagacctagctattaaggtgagtcgcccactctgcatacttacgagtatgtcgaagtaacgatagtctttttagtaaagttgcgcttcagatggatcgtgatcaccacctgatactgtctttttaacgaagctctgaaagtttaaatacttataaagcatgtgtttgttaaagagaccaccgtcctgctgttgttagttaaaaataaccaggttaccgaattcatatgaggaagtctttaagaagatatgggggttggtactcccgaacggataattagtacctgattagttaagaactcgtgttggtcgtgcgttaacggctgtgcccattg

SEQ ID NO: 2424 - DNA, 792 bp, Brevicoryne brassicae picorna-like virus
  isolate IL, complete1
ttgaaaagatcgtgtagggtatttaccctacatgatctatcatattcttttcatgacgacatttgttcttgacatgcaccatatttgttctctttgaggattcttatggtatatgttacaggattcttgtcgtagtcgtttggatatgattattggcacgtcccgctgattgcgtaacaatcaacaatttagtctataagctttcttttcaaaatttaaataattaattcgctctaacaacattagaattcttctatttcaattatactttattaaccaaaaatatttagctttaagactagctttgtgagctttgcacacacgtcatttatgtattacactttagaaggtaccataaatggacaatttcggttgtcttggctgatacgataatcagtttctattctaaggcttcgggtgaagtgtctatcccgttgaaattaacaccgctggataagagtctttaaacttactatctgagattgtatttagtacaggcgatagttttatgtaatctaggctggagacagtacgattatataaatctagtttaaagaatttctgtttggtttgtgtatggcatattcagtgattatacgtaatcactgtctcgtttataatgtttaatatttttcggcaaacggaaggttgtagttactctgagagatttaataccgtatctaatagaatttagaactcatgatttgttctattagtccagcatattgctataccgtattattttgcctttagtagcgttttaaccaactgacttattagccgcatttacct

SEQ ID NO: 2425 - DNA, 792 bp, Beihai picorna-like virus 1
  strain BHZC36988 hypothetical protein 12
atattgtacatattgtcctgggaagacgtaaaactcattccaaccccccggaactattcgtgggatgtgtaagtttaaaatagtcttgtagtattggttaccgttaatctgtaaatttttgtgttatttgtatttctttctggcttgctacttgttgacacttccctcgtgaagtacccgtatttacgggaggtttcgtcagccacacaaacactatgcaggaagtgcactgagcaatgcacttaccctaagttcataaaatagctttctaatataattaataataatgataataataataatgaaggaggtgccgcgtatgacatttccaaaatttcaaatgaaacaagtactcaaacaactaattttgttgatggagacagcccttggtcgtatgacattgttgcaacacctgatgagacaaccagactcgcaggtttcactgacgcacaattaggtgatttcctcagcagacctattaaaattaaagagtatcaatggactccgtcatcatcgttgtctgtcgcacgttttaatccgtgggctttgttttttgcaaatgctgatgttcttgataaaatcaatcgctatcgtaatttacgttgtaatcttcgtcttaaggtgttagtgaatggcaatagtttttactacggccgtgctttactttcttataatccttttgttacgaatgatgaagttacagtgaatcgaacatttattgaacaagatcttgttcaggcttctcaaaaaccccatttgcttttagatccgacttcttcgcaaggaggagaa

SEQ ID NO: 2426 - DNA, 793 bp, Toad HDV-like virus
  complete genome
ttctgaagaaaaccccgggaaaggaacaaccccgagtttttctccctttcgacagccgccacactgtctcatcagctgggataggggctctgtcgagccccccggcccccaggagagagaaaaactctgggcaagagattttgatctccttattgagaggaagatttttggaagattccgggagcgggaattgttcttccgggcgagaccgaccgtggcccatcctcggataggtcgggccctctcgggactgctgtcgccccggagactctcggagatggagatgcctcggcgcgggtggcctcggtccaggaggcgaaatcttccgtttcaagtcggaaccgatggagtcccccttgggtccttcgaaagctgaaagaagttggaaaaatcgggcatccggagaacctggaaatggactttgaggagagtgttgctaaggctttttacctgtcctgtttttcccgatttcccgcatgtggctcttccgcaaagaggggctccctgaccgttttgtccttcctcccctccgcgcctttcccagttttgctccgggaaagaatttgacagtttcttctccagatctctcgattcccttagggccaaactagcccccgggagcggcgcgttctcgtcggttccctccccccccattactaacaattaccgtctgagttcattgtccccaaatcctcaaacgggatcgcccccgggctgcagcgggagtctaaaaagccttttggcataatagttctccgctgagtcggaggcgcggtcccctatttttgaggaa

SEQ ID NO: 2427 - DNA, 795 bp, Beihai picorna-like virus 21
  strain BHZY60822 hypothetical protein1
taaagtctccatgcgcattatgcgcgtggagacttaaattgaattaattggcattaatatatgcccttgaaccttgtttacgagctatgaagggcattatgatgcccccatacctcgaaggaaagaagcaagctttagatcctttattgtaggatcttagtttgatttaagttatttattttattattctactggggggtggtcccctacaaaaaccacacactatatgtatatggaaaccaaaacgatggtagtagactctctgttggagttgaagtccatggccttaatggcaagagatatcgtggaatgccaccacgataaataaattaaataagcaacacgaaataattcgtgcattttatcggagtaacccgaagtgcgaaagtgctcgaaggtactcgtgtatatttgatatgtatccttgttcgggatgctgtctagtagccactgtcaagcctagcagtgtagtattataatatattacatcattgatagtatatacgagtataggcggagagcagttagtaacccttgtccgaagaggaaaggtaggtgcaagcagtattgtaagccttgttgcctgacacatagtctaaggaaaggtcggtctcgcccgttagaagtatcggattgtttagagtagttatatcagtagacgctcgttcaaaattgttaactgaattcttaatatttctatagcagaattaaaattgcaataggactcaaattagaacaaaagttattataaagaattaaaacgatatttttgaggtaaattgacaaagacagaag

SEQ ID NO: 2428 - DNA, 796 bp, Yado-kari virus 1
  genomic RNA, complete genome.1
tggataaaaggccgacaccttttatcccttctatcaattctttttgatagttgttttctaagtcacatggtagcgaaccacaattcgttctttgacgttgttatgaactcatatcatttccataacgtaattcgatcaaaagtcttggtggtgtgtacttcctcacaccttgtcgtttattttgatgcactagcaacgacgtaaaatgcatcctattttacaatttcctttcacacgtggagttaaaccttcactttactctttttcaacgtgtgcctagcattgtatttgaaagctaagtaccctgtgtcatatgaatcacacatccttgtgatatttctagtggtcccaagctcgtttcagccgagtataagatgacagtccctgctgttaattgtgtcatctttagtcccttgcccccctatcttcgtttatttgaagatagataggatttggtttagccacagtgttctatacctagatagctgcgggacgtgattccccgttgggaagctatttctaaaacaatcacaaaaacaggtataaaattaaaaatcacaaaacaacttaaacatgcatggttataagcatgtgcgtgactgagtatgtcctaggttttgcctaagatggaccactacttcacgttgttataactatttgaatcatacactattcatctgtgcctcggaccggccttgtaggaccccgacccatcatgatttctatccgcaccaaacatgtcaagtcaggacctcaacgccaatcccccgttgtgccagtccattgattcatccct

SEQ ID NO: 2429 - DNA, 797 bp, Beihai picorna-like virus 36
  strain BHJJX25939 hypothetical protein1
cctgcaggtattacctgcaggaggtctgagatctggaattcgtcgatctgcgacgacaggctggttgtttactagctttgttgttgtttttgtgcgtggaaacacccgtttcatctttgtatgtatgtatattagttactatatgtttgtttgccggtgtcgttaaaccggccatgccccgcatatgcggggctagtttatgttgtaaatattgtatcctataataacgtatggtccctgttcggaccagtgtatgaaaaagtggactattttgggttggagcccaacatggaggaacttaccccagtagtttgaactggggacccggggtcggtttaacgagccggccccgtgagttctggattagcatggcgctgtccacataaatacgtacgacctttattttagaataataacctttgcggatgccttagggtgtacgcagtatacagacgacaggtcaacattgacgtttttggagttggtccgtgcctctgtgctgatcccgaagcacatgcgattaaagaacgacccgagatatggtatcatcatttgtagttgtacgaagcgtatgtatctgctattgtgtaaacatagtctggtaaagccatgatttatagcatggacaggccagtttgtggtactgaagcagtagatttgttagcatttcgttagtggattgcaagtgatggtagcgaagtccccaagaaattagatgttgtccgatatttgagcacgcgacttttgtcgcgagctcaagtcgtcagttgttactgacgaacttgagactcgcgttt

SEQ ID NO: 2430 - DNA, 798 bp, Beihai picorna-like virus 29
  strain HOU158675 hypothetical protein1
cggacgttcacgtccgtatgagatatagtttagttggcagcttagcccgctgcccgggttttacctgtattttaggtactgtttaggtttgttcttgaatgggatcgcaggatacatggtagaaccatgattctgtcccatttttgaggaaacctttctgatactgttacgattgacttctatataaacgttttttaatgctctgaggagtaaaccttataagaaatctagggagtccaccctacgacaaaacaaaccccaatgctcatgagggcctgcgcatgtcgcttttattgtgtagaccttccgtacgtcgatgagggaagtttaggccttgagcaagcctttagaacttcttaccttactttcgagtgaggtggcccacagtggtgtggacgttcttgattggaaatgatcatattaggtcatagtagtgaattatgatgatgttatgcataattcgaacttattgaaactttgatatggtaatgtcggtttaaatacgcaaaagtgtgtgagactagagtactcgactttgctaccgaatggccctgttattggaaatgatatttgtatcgatggcgtattctgattctgcaggattcttacttatgagatgtgtgagttttatccggtcataagcctaattatcatagtgttggatgtggtgagggttaatagcccaccagcttctatgcaaaagaacttagctggcccaacacgccagacgcctagccttcgggagggaattttatcgttactaaaaaccaaacacagagcggggagagcttgctgaca

SEQ ID NO: 2431 - DNA, 799 bp, Beihai weivirus-like virus 15
  strain BWBFG27289 hypothetical1
gacatgtcactccagaattcgctgcccccgggtcggtcagggggtggcatatggccgtggagaaggccttggtcgaggagtgtcggccatgcatgtgtggggggccggttgcccaccggtcgagatgggggccctcgagacattgccgactcggggataggcgagctcaccgctgaaacccttggcttattctttcgtgcgggcgtggtgtgacgtcccgtcaaaagcctgctggagtatcggcactcctgaggtgcaagccagtacgcgctgtgcttcgaggtgggcacagttcctttgccagggacgaaggcgtaccaacgtcactcaccgtgccatccagagcaccaaccatttgtggcacgggcgtgtgagtcaggataccacatctgtgggacacccctggtgttgtgtggaaatcggaccgcgacggagcacgccacgtcgcaacgggcaccgtgggaagcacatattggggaggcagagtgacggggaatggactacggcaccgctgcgccgcggaggcgcctgccctcgccattttggcagacggcagatacaccccacaattttgatcgattttccgcgcacacccgcgtgtcggtgcgaccgactgccaattttgggactgtatgaagcgcgtctgttctcgcgcgtccgtgcctatagcggacatcacggtccacaagagacaagtgatcccacaccgactgaccgagctccggcagccgccgggggaggttttgcacgaaggagttgagacgttcggggtctggagagagtggtaccgtcgtgtgcc

SEQ ID NO: 2432 - DNA, 800 bp, Beihai picorna-like virus 24
  strain BHZY60459 hypothetical protein1
tgcaactgtgctttgcagcacagttgtattacttacggataatgtaattcggtatattttatcgattatgttgttgttaacagtttatgacactctaaatgagtcttacatactggcgcctaccgcggcttcagtatgtaatcaagaagaaagttccatcgactgtctaacgacagtcgtggtttctctctttatttgtattataaattgctaatatcacaattatattattccgtatattactgtgtatttctgtatcatgtgtaatatgttttctaatcacaggatgcttggtcaaggacttaaaagctcccgatagggcaccatgggagaactgattattaattcagtatcttaaacagcagtattgtctaaccacgactagcctgcgtctattttctcttttagttaaaataggacaagcctatcaccttgcgtttttgttaacgcccactagttccgattaaccaagtggttaaacttagaagttaatcaattaagagatgcattggagtcctctgctccattactctataaaaacctaccccaaagagtagaacttgagggatgatatgattatagcctaactaactggcaccataagtgaaaacgttagtccccacacatgcccggtcgtctcttgtgacggacggggaatcgtagggtcatgatcctcacgacttgaaagagcttgctcttagcaaaggatatacatcacggagatctaaggatcaatgaagtgattaaaacgtggcccgccgtattgaacatacaaacccattaatttcgggtttagttca

SEQ ID NO: 2433 - DNA, 800 bp, Beihai octopus viurs 1
  strain BHZY180716 hypothetical protein 1 and1
gtgctgcagcgcgtaagcgctgtagcactccataggtatttggacctcaaccggtccaggtatcactctacatattatatgtgggcgtttcgacgccctgctgtatttttagagcgttaggtcgctctgcaatattgcgggcgtcaagcccgtagcattgtagaagcacagtaagattttggaactcttttaaccaggtatcgatggtgttaaaccagccatcaccccctttttgtcctgagctggacgctaaacatgctcgattgtcctatagtaagacattaaactgctttttgtccatgagtaagacataaaatcgctcaatagtcctagatatgacataaaactttctgttgtggctttaggaaccacacactagacttaaaattctgtattgaagaaatgttcggatgtagagatttaagcaacctctctgcaatacgcaatatgtaagacgtatatgtcgattgttgtgcaccctctatgatcgttccacagaattaccgagccccgtcgtgtagcgagcacctcggcggatgattagttaagccatgtcgaatatgtaccgaagcgatcctgcgtttttaataaacaatgatcttcggagccaattacatgacatgcccaggctactatctgcgacgctgttaggtacgagtgtaagaaaaatttcttatacgttgaattttgatgttcgagtgccatttaaggctatcattataggttattcctatgtacttgatgctagccaaatttaaaacctatatggtcagttgtgaactgtgaatcactcggcttgg

SEQ ID NO: 2434 - DNA, 801 bp, Heterobasidion mitovirus 1
  strain an1 RNA-dependent RNA polymerase1
ggggtagactcctaagataggagcctatctcggccaaagacgaggccgatgatgatcagattcatcatatgaagatgacatcaccacaacgcgaggttgcggttaggaatgtcccttgattagtaaccaaggcacaaccctttgcataaggaagtagacgttgggttgaaatacctaagatccataagatttgaagagataacatcaatatcaaaccatatgggttatagtatgtcgaccttctattctatctggtgtcgaatcagattagaaagacaggacgaaccgtactagacggcccttatttgcttttgcgatccgcagaaggaacctttggaggttcttccggggtggaatatataattccggagatcaatgactttcgtcattccaaagattaagtgttgagtgctctgatcggctgtatgaaaattacagtccttcatcctagcacttctttaatggggtgacaattttacaaagttattgtgaaccagaattggtattccaataagcatatactcatacgcttattgttaatcacgatattgtatatgtggaaggataatccaacaggtaaccttaatggtacctgtgaggcaactctgctattaatacgcagagtagaggtaagtaattcacctcacccttacaggaggtctaccagactctcctagagtagctgcagccccttggacctaatgtgaaaacattgggtccttaactaatcccgttaaacggagaagagggaaactgacttttacatgacctagttaacgatacaacctttaatcacaaaat

SEQ ID NO: 2435 - DNA, 801 bp, Niviventer confucianus picornavirus
  strain Wencheng-Nc42-21
cagtgtgtatgccatccctcatagcatgcctatgactgatggattcacaaccctttcataacccctcccctaattcccaccttgcaaccatacgctttactccgcttcgggttttgcggcccgatgtcgtgaagaaacggttacgcaaacttagtggcgaacggggcctgccaccataagtggccccattagaagaatgtacgatccgcccagtaggcggccaccatccaggtggtttacgggcaagcacttctgtttccccggtgacgttacataggatgtccccacgtctgaaagtgactgatccgttacccgcctcaccactgcgagacggttagtacgatgtaatagctgatcaccgttgatccgggcgttttccccccgcccagaaacatgtgatgaggagcggcatccctcctatggcaacatagggcctctcctgcgttggcacgtgggctccttgagcacggtgtgatgtgaaagtcatccgaagaccttattgcgctggtgttgagtcctccgcccccctgaatgcggctaatcctaactccggatcatccgccggcaagcccgccggtagggtgtcgtaacgcgtaagtctggagcggaaccgactactttgggtgtggcgtgtttccttatttgtttggttgattgcatatggtgacaattcgttgtattgacgtttgccacttcccctgcaaatattaccaaaccaggtgctgtttttgtgctaactcctgccttactattaccaagaaattttcagagtcacttattccctcggttgtttggagcata

SEQ ID NO: 2436 - DNA, 801 bp, Beihai picorna-like virus 79
  strain BHBJDX18844 hypothetical1
cgagggggtagtattaactaccccctcggtatatgaagtcatagacgagacttcttaatttacacttagtctattctttggtcgtatggtatctacgggaccatgcctcacgacgtccaatgtcaataagtggcgctgacacgctagtccgctataagcgggtcactggccatgagatgaaaagcctattctgaatatgattatttgtaagttatttacattcgcgaaccccataatttgagatacagtatgttcgcttcggagcatcctggagcattaacggttaacagttaccggctcgaaattgcacaacaacatcgtgcatcttgaccatttactttacgccaatgatggagtaaccatttcaccgacaagctagtactcttgtacgaaacactaggattgaaatgttcgaaactgattttagtattgtaggtcaccactttttactcttacgagagaggacgtagctttcccacaagcacgtaatagtgatgaaaattcaccattaagggagcagtaagcgctgtctgaacaaatgctgcgtatgtgcacacgcaatagaagaatgcacccttttaccttgccggtgctctcgcgagcatcgggttcaagtccttcacgaatttccgttgattatgacgattgtcccagattttctggttgtacgataagagtcaactgataataggaagtagtgaacttaattgtttgcaatgtcccttggaggcgcccagacatcaccaaagccatcttttggctttggcgttatttgggcagaacctggttaccgaaactatc

SEQ ID NO: 2437 - DNA, 801 bp, Beihai picorna-like virus 49
  strain BHZC36855 hypothetical protein1
cttctttagattagtagtaaatatttgtttctgttcattggaaaactatcagtaatataattattgttgttatgactgatgtgcccaatttttggaacggtaacgactgcgtagcatcccccaatgtaggactacgtagacgcttagtcggtaattgtagctattgatagttacatttcgtgacaggttgaatgaatattaaaaataatcatagtacaccaatttgatgtaggccaacccgttgtttgtatatgcatgtttcatatttgcgtttatatacatttgacaaacagtttttcgtaaaaagggctttactgttgtgaataaagctcgcgccgttttgatgtggtaagttaggccgcaccgttgggcgcacgagatttgaagaaaaaacaaaataaaaagaaaataatgccaaagaaaaaggtagcagaactaccatgtatgtttaaaagtgctggcagcaaaccttgaatgcaatgttggagcatggtatgagtacactgactcgtattgatataagaggttttctctgcatagtcactgcaagttatacggttcacactagtatcatatgttacaaatgcgtttgttgagtagttgtttagtttttaatgcgttatgcaccctaggtaattagtcaagtagtatgagtgatcatgtgcgttgtttttatgttacgtccagggtaaaagtcccaggaacagtttaccgctcctgtagagcgggtagccgagctccgggcgataaacgcagcacgcaaagaccagagtgaacacagttaagtaataagtaagtaat

SEQ ID NO: 2438 - DNA, 803 bp, Plasmopara viticola lesion associated Partitivirus 6
  isolate1
ggctcgtcccaagtcgagcttgcaattgctaattcattcctcttttcccctctccaccctcaagctctaaagcaattatagcaaccatgcagttcgagccgccgatcaagccagccgacatgaccattaagatcactgatggagacaatagcaaccaaagcatcgattcgaatggcatcgtgattggccgctggaagaccggtctctttggtttcaccgattcgatagtgcccaatggcgtcatgtcttgttgctgtcccggtcttgtggtagctcagatatcggctcgtcttggctttatgccattttattacgtgctcagtatctttggagggctttatctagtagcacttattgcggtgacaacccacagtcgctttttcgactttattatatggttgtgcgttgtaatatcggccctctccatgatgcgtttgcgctggcgtattcgatcacttttcagtattcctggatctcatgctgaggacgccgccttcagtttttgctgtggatgctgctcgatcgcacagatggcctcgcatgttgaatcgtatgagccgggcactttttcatttgccccacgcgccacacttcaaggctactcactgaattaaggctttattataaaatagaccatcactatttgcctggaggaagatgggtacgcaagggtacagatataatctctaatactatttacataggcgatttccattcgaaactgaactccgtaactcaatctttgctatactgtcgcaaatttttcagctcttcctacgcttttttcgtaacctctacccact

SEQ ID NO: 2439 - DNA, 803 bp, Human parainfluenza virus 4b
  strain HPIV4b/Seattle/USA/SC0496/2019,2
tgcaatcaaagcattagaggtgaggttagacaggatcgaagggaaagttgacaaaattatgctcacccaaaatacaattcagcaaacaaaaaatgacactcaacaaattaaaggctcacttgcaacaattgagggcctaatcacaacaatgaaaataatggaccctggagtcccatcaaaagtaagtcttagaagcttaaacaaagagccagagcaagttccaataatcgtcactggtactggcgatgtctcaaaatttgttgatcaagacaatacaataacacttgatccgttagcaagacccattttgtccggaaccaagcaaacaactgatgaaaggagagcaggtgttcgtatagatgcacttaaaataacagtatcagaaatgattcgagatctatttggagactgtgataagagcagaaaacttcttgaatcaataaacatggcaaccacagagcaagaaatcaacctgatcaaaactaatgctcttagaagcatcacttaaactatgagatctatgaaccacggaggtcacagtgacccaaattcactcaatacgccaagcaatcaaccccacactcagaagggacaactgcaccgcatccctaagaatcgacaccaactcaagcgacggcgacatcaatcatcacaaaacaaaatacagaacatcagcactgcatacaaaatcaccccccggcacacataattcatcgaccgacagattccctccatgacattacaaagtatttaagaaaaaaaccaaaagtaaggggggacccatcatccaatcgactgtggcc

SEQ ID NO: 2440 - DNA, 804 bp, Weivirus-like virus sp.
  isolate cra070shi3 genomic sequence.1
aaatcccctccattagggccggtcatctgcaaccggtagagttattttgtttatcttaggaaaacgtggcatctcaacaccaaaaacctgtaaaaaagggctgtttaactcgcattactgctaaagtacggtaaagctaaccggtaaaaagacccgggggtggaaatcccccgggctctttttaccggttagctttaccgtactttagcagtaatgcgagttaaacagcccttttttacaggtttttggtgttgagatgccacgttttcctaagataaacaaaataactctaccggttgcagatgaccggccctaatggaggggatttctgcctcaaagtttcacatactaagttgtgagtgtcacgcactttacgcgtttttagaattagattagatatccgacttactacatcaggacattaggtcttttcacattttccgttcgtctgataatgaccgctgttggttaatattttgatgggtttaacccactaactccaaccaggcattatttttcgttcacattttccattaaaactaagaatgaccacgtttggatacgctgtctgctttgaggtttttgcttacattgaaatagagcgcggctctaattactcattgaagcaaaggctagcttagtgacactggggccacacttcttgtgttatcgcttagtaacgcgctacggcgtcttcccccactatcgcaatatgtgcgggatttagtcaggggcagtgcctgacactttattgcgtttttctatattttgccgttttggacggccccacagctggtaacacct

SEQ ID NO: 2441 - DNA, 806 bp, Warroolaba Creek virus 2
  strain WRCV2 205660 hypothetical protein1
taaggcataataaccgaagttacccttaaaaccaacattgaaaacaatattctacctaaaagtcgtgtgtacatatatatatgtacacacgacttttaggtagaatattgttttcaatgttggttttaagggtaacttcggttattatgccttacggtcttcattgttaatggttttcgcggctcgcagtccctaattgttgaattgttcttactgatacgttgtcttcattgttgatggtaagtagagtggtttttcagaagatagctctattattactgttttcaatgttgatggccttcgtttggactttctttattaatgacggtaatcaaagattacacccaattttagaattaaacttttaagtagggtatgctgattttatcctctctcttaattgattttgatatctggtaattgatctcgaaagaagatgcgtcttctggatttgtaatagctgggccttaagatcgtaggtgttattacatggggaaacacattactttggttgatgatgatatttcgatgatgattcatgatgcatgtgcttgtattaagcctgatacaagaacttactaatttgcatagtgcaaagggttagcatatgatttctctgatgtggattttgacactgcctttgattaggatgtgtggatgatcttgaagcatcattggatgtttatgcgagcgtgttgtttaccaatttcaggatatgtggaagcggttgtgtatgatctatacgcacatttagttcccagagggcgttgtcgtctccccctaagcaagggagaaacacgtggcac

SEQ ID NO: 2442 - DNA, 806 bp, Wenzhou shrimp virus 4
  strain WZRBX43306 hypothetical protein 1 and1
cccgccgcccttcaggcgacgagtggaggtcacaagccctcataaactgtggagtgtaagacacatgccctttaaaggcatgaagattcttgcttattttagcagatgaatcatactagcttgctttacaatattagcaatcgagccagaccacgaggattgaacttcaattgaaaatgaaggacggtccgaatgccctcactttatagagaagtgtgccctcactttatagagcagtagcgttttccctcactctataaagcagatccatattataattgttgccctcacttgattgaatatttcaagccagcgaagcaagttggtgtggtcccggcgtgttaggtgagccgtttaagacatctaacaaatatttagtttctttcttttctcgaactaaattctttacttcaatcgctgaaacttgtatgtgacttaacttaggccagcatattttgtgtaagcgcagtgatagtctgactctatccgaggaatcactacctcgttaaataaatgtggcccggccagggttatccaagcctgagacttcgaaactctcaggtggcatacttcaagcggagcgtaagacctaaccaccgttggctagtggcgcagtatgagcgaattaatggattgtagcaaagtagctttgaataactcctacgatcagcacgcaaccgggttttcgtgccccggcattatgcaactcatattaacggctagcaaagtctatgtccttgtgtggacatgtgtgtgtgggcccttaaccgggttatttgattaggctatattcgcgaccatatatt

SEQ ID NO: 2443 - DNA, 807 bp, Shuangao insect virus 8
  strain insectZJ96360 hypothetical protein1
tacacaacaatcaatgaatttacccccacgtgatgtagttgtgcctaacgttcctgaaacacaaactaatatgggaaccttagaacacactggattacctattgaacctatttggcaaattacggatatacctccggattttaaatggatgactgaacaatggaaatttcacacaacttttgaagtaaaagatacacaacttcctggagatgttatttatacaacacgcgttgttcaatctgatgcaagtaaggattctaatttaacattggcacaatggcatgatattccattcgcttgttctaagtggtggaatggaaaaatttcttatcgttttacgatagttaaaccccctcgtgttgttggaaaattattaattcgatatcgtcaagattgtttcgataaatggaatgctgttgatgctcctagctctggttgggacatcaaggattcgaaaatgcgctcaattttgaaagaatgggacttaggacaatcatcacagtttgaatttgatattacaggctcaaacccaattcgtgcccgacccacccatctttatgaaaataaaccgcaaatagatggaactagtttaagtttaaacgatgttgctgaattccgaacaccttatatcctgtttgaaatgggacgtatcagcatagaagttgctcaaaccatatcacctggtggaatttttccgagcaattatatagttatagttgagaagtgtttgaaggatagtgagtttatgaccccaacggacccccgaactgatcataaattgactttatataattctattactgaatc

SEQ ID NO: 2444 - DNA, 807 bp, Beihai picorna-like virus 14
  strain BHHK130444 hypothetical protein1
ctccacgtgcgcgatttgcgcacgtggagttatagtgtagttggcgatcttcttcgcccgatttaagtgttaaggtagtgctattaagcgttacgacgctttctagttctgcacttaatacttttttttgttttacatctttatcatacccgttccctgggatagtgggaccccctctgtcatgaggtaagacattaactgagattagacaggtctgtgaagtatgtcaaacgtatatatagtaataccgatttcttatgcctctataggaagatgaagtatttaactggtggtgtgtacttgtttttaacaagcgcgtcctttatggattcacactttatcacctaggaataggtgacaccaagttactcgtaagagagactatcttgtaatcggtcatgaattgataattcagactcgattgtaaactgatctttattgatcactctagcgcctacttggcgtattttgaaagagtaaggagttcgagacgtgccctactagcatgggccgacgtaatggtcaagcgaaactcgatttatctcattagttccggtgagacttcagaatcacatatcttgagattggcactcgatgatagattgtgagctacttgacaaatataatatttaggacactttaactagcatttagcaatagttttatcgcaatgtttagggtattcagaaaccttggtatttataccgtaagacgatttatgagttatttcgcgaattttagtgtgagtgtgatgtggattatttttgcattcgagggactaccatccttttattttttgaacacagc

SEQ ID NO: 2445 - DNA, 810 bp, Wuhan coneheads virus 1
  strain ZCM4592 hypothetical protein gene,1
gcatggggacgatatccccatgcgatcggcctgtgttaatcagactctgttatacctagtgtcttatttggcttccagtaagacacaatttggtatcagacaataattaacaaaacaaattaattttaaggtataattttaagtaacttagttcaaagggctattaaacccctgattagtaacaaaattataaaatactcggttctgaccggggtaattcttttaacaataatatatgataattttatcgaagataacagttagcacctaccagatggcgctgttgcgtagagtataacccccaactctacttcccaactttgataatttttaattatatttttggagaattatgtataaaaattgaggaaacccctcaggtttaactacgacggcgaattaagatgagcgaaagtaaagtgcttaccaaggaggcgtaataatagggacccctctaaccagcaaacactggacgttacttaaggtaagaattacattttattagtagccggcttatagtaggcgtttaaggttaagcgacaaccctagtggtttacagtattctagcctatgtgctaatcctcgacggcagtagatcgctggcgatcgggaatatacctggatgtgaattaagtaaatctataggtatggatactcttctgaccctccagttttacactgtactaatcagctgaggaagagcagattatttcctttttttttcttcttatggtgacaattttatgatttatttataaagttgttatttaatttgaattttattgtattgacttatatattttatttaaa

SEQ ID NO: 2446 - DNA, 811 bp, Beihai sipunculid worm virus 1
  strain BHNXC40689 hypothetical1
tatgcaacttcctattgaagttgcatcgagtgttgctgtagttatttgtgagctacgcattaaatttgactattcactaccaaagtagacgtcaatgtccctattggacttggctatctgctttatgttgtattttgaagcatctttgtgttgctcttctgagtagcatgaagtgttttcacctttatatttagttttttgcaatcttttgattgtcaaaccactaccctagtaaaattacatcggtaattcgtctttatgtttgtgggtctcaccacccactacttgtatattatatatgtttgatcggcattggttataaaaatttttgtatttttaattaattatttgtttaaaaactgtcaatgtcttaaactagtctttgtttctcatcttcggtgaaagttgttgcactttgtgctgacgacttttattatgcgaagtaggttgtatctgcctgagtgaggtacgtattcaaagattaagactgttcgaatcctgtagcgttccgtgattggtcttgagccatgagccgtccgcgtaacaaggtaaacagtaaacaaaaactgtaatagacttattatttaacactatcgcagtactgctctgatcaagcagttgattggtttcgcaagccatgacaaaagggtcatctatgatacagaaaatagacgttaagcaaggtccgaaataccaagggtcccgcttcaaccgatgaagccctggaaacaattattctctctgctgtttgaagtgcttaacaaattctcagtcattctccactgagtcttcttaattcacttccataatc

SEQ ID NO: 2447 - DNA, 812 bp, Plasmopara viticola lesion associated mycoophiovirus 4
  isolate1R
gacataaacgctaaaggcaagataggataagtggaaagtcacttctgacgccataaaaacatgcagtccctggaatccactatgacagttaaagaggctggagagctgttaaaccttatgctcacgcatcatggccaatctcggagggatatcctcattctgttcgctgactttttcatgaagatgtcaacggttgtagcagaaaggtcgtcaagtgcatggtctgagcggatgtcacgagcagcagcttgtttcaattctgtaaacggttctatgagaagtgaggaattcagtaaggagcgccttcaactttccactgcaatcatagcacttagtagcgcaacagatgccactccgacgctcgatttcttccggttgaacacaccagagatcctgatagaggttcaatctttccgctcaatgcaccaggttgatcaattgtccatccaactctctatgaggtctgtatttatgttctggcttgcattcgaccaactcaggattatcgaagagtcgcgctctatagtggaagatgcactggcaatgagcttgagtaaatttgtcgaagagaatgcagtagtagcaaggtggttttcattgatgatgacagagaagttcgatgcttccatatgtacctccgtactcgatgatactgtcatggtgatttccagatgattctgcgagttttcctttgtcgtccgagattcatttccatatgatcttaaaaaaactaagagaatgaatcatcacgattttatcattataagtttaagaacaatcactctcagcgaactacagattactacagaatc

SEQ ID NO: 2448 - DNA, 813 bp, Beihai weivirus-like virus 1
  strain BWBFG40821 RNA-dependent RNA1
gggtgaggggaattcggggcgtatgccgcgccacagtggcgtaattggcagcccctgcattaggcccaacagaaaaacctaaagagggccgcattttttccgggcaccgtgggcccggtgaaggggagcggcagggggacaatacctgtcgtgagatgaccgcctcgcatgtaacgggagtttaccgtctcacttggagttgtgcgagttgtaccgcgtcccaacgggagtgtcagccttgttcttccagccctagccggtccgcagccggtgggtcagagcctgagtggggtcctactccgcccctgaggtgtggccttgcacgaccgtggatatgggtcccacgtgggtttcgccagcccttaagtcgtgtatcccgagtcccccattgggaatggcccctccagagcgtgtacattttgagcgctcgtacgaggaacgtcgaagctggttgcaggcgcgaaatcgcctgcagttggttaggggaccagtgatgatgtctacggaaccgggggcggcggccgaaaccgccgcggatgacgcaggagaagcaacgtacccgatctgaccgagcttgagccggcgatggaaggacgggcaacctgctgtgtgagggtgcatcgcgtaataccgaccttgtcgggcccatcctccagtcatccacccatgtacagtctgcgggcgtctggtgtgcgaacccccggcccggtccgggcacaccagacgcatgtatagggccgttttggccatggctcaggcgatccccgcctgagacggttgttttgtttgttttcttttttttgtttggacgtg

SEQ ID NO: 2449 - DNA, 815 bp, Barns Ness breadcrumb sponge aquatic picorna-like virus 1
  isolate1
tcccgcgcacgcgaaagcgtgtgcggagttgttgttgtagttggcgtttatacgcccatcatgagttcaaagtaccttctttgctgcgttacgacgcagccccgaagttcttttaacttttgttgtttacgatatttatcagacccgttccctgggatagtgggacccctgtcatgaggataatcattactgacgttagacagacgtatgaagtatgataaattgtaataagtaactatgaaagagtttattcctcaaactcttaatgattagtttactaaattggtgtgtaccttcctttacggaaggcgcgtccattatgtttttaacatttatggattcacattttttagtctagtaatagactacgatttagttcaggtaagactgacttttctggaatcggttatggattgataatcctgacttgttttcaaatgatcttgattgatctctcttatgcctattaggcgtttatttaaagagtaagacgttgaattatgtacccttctagcatgggtagacttaattgtcacacattgttcattaagactgttaattccggcagtcagtaagaattcagtgttctgagggttggcacccgatgatgacactgttgctactttaatttaaacaaattttaggacatacatttaatttcacaataaattattgtcgcgaagtttggagtattcaaaaactctgtagttcgctacgtaagacgactttatgttttgtgtattgattttgtatgagagagctatttcttgtattatttgaaatcgagaaaccactccttttatcttggatacagc

SEQ ID NO: 2450 - DNA, 816 bp, Dinocampus coccinellae paralysis virus
  strain Quebec2013, complete1
aatccctccatacatcttaccctacaagggtcgtaaatctgttcaaagttaatttcaagcagagaacagtagatattttatttaattttaagacatactttagttcacgaggctatctatttattagaaccctctattagtaacaaaacattaaaatactcgtttcagaacggggcttcattttgaagtgaataaaatatttagataacttagtaagtacctgaacgaattataaatagtaaaagaacgagttcgttaggattgaatcgtaaattttaaataattcaattactatatgcttatgccaggtatagttctttctatatatttgacttattatatattatagtgtactagtctacataaatccattgtagatgatgaatatggcaagttggaaccagattactcatattcttgtggcgtagagtgctctccaaagctctacggtcccctataattataataatgatagtatatagaggagaatagtatcgtttctcttttgaatgagtataagtacgtaactttagtattcgaactttataaggatctcgtgggaacgctagactgcgacttaagtgaatagcctttaatcacttagtacaatttgtttcagtataaacatgtaggccggcttgctacgtccgcagaggagtcgttaactatttatcattttggtaacttagtcctcagacggtgacggatggaaagacatcgattccttttatatgcagacaacaattattgatttgattttatttccttgtttgatatacacttgttttatttccctttataatcaattttgttaat

SEQ ID NO: 2451 - DNA, 817 bp, Unknown
  Description of Unknown: DsRNA virus environmental sample clone smat.culi_contig1191 sequence
tagtgtgacgcctatacagcgtcacagatcttcctaccgaaggttggtgggttactatgcggagtcgcctgtcgagggccatccacaggagtgggcaaccctcgggagatgaaccggtgaccctttatcgctccgcttgggtcccggccctacctattttctcgttcacctggcgaggaagtaggggggtgggcgtatgcctgccgtacgagtaattgtacggcgtgatttcggtggggtacttagccttcctgctaggttcctcaccagaatttccccactagatctatccaatagttgtgggcagggtctatttttgcccagtgtatatggaaacactggagtctcttatagggtctgctcatgagagcactaactaagtcgatagcttactgatagtgagtaagtactccttatataacaccttatatgaccactcctgcgaaatgcaggggtacctgaagtcttacagcgccgagacaatgagattctcggtggccaaaacgtcggtttggtatgaccagggcgtgctaagtgatctggcgctcgtttaggcggcggttccatatgaaccccaccggctaaacttgcttccttcattggataagatctaaatgccgagagactgcaacggccacaatgttgtaggggaacagtccctccttacgttagggtaagggggcagttggtgccttcactgttataccgaaagatttatgacaagcgatttccaagtgattttttagattgagaaccgagcgagcaaatttgaaagccagcgttaagttgagaaaactattcgagcctattgggcgtt

SEQ ID NO: 2452 - DNA, 817 bp, Wenzhou picorna-like virus 41
  strain WZFSL80064 hypothetical1
cacgtgattcccggaatttttatcggcgttaacgcatattattacatttattagtacgtataatagcaatattgtattgtattagttagtgtagtatgtgtgttggtgtctggaatcgttactaagaaattagtagtttataagcagaaatgcttattctcaatttttatgtaggtaatagggaaaccgtcaaatgcagtcgtagggaataaataacttacaactgatacctacattaggattcaacgacgattacatagttgtgattttcgttgtcttaggaaatccggaaagtatttacataatataagtacacgtagttatcttgaagggtacccctcgtccgtaaggaagtcagttgtttccccttctgactagagccggtagctgactaagcccgatacgccttaactgtgttagtttaggacctttggctgcttagagtaacgtgctctcccaatggataggaactgcttttacaaattatacatattgagctataatgatttagctactcatttgtcgtgggtgtatgtataaggcgtaatttctaactcctatttggaacatggctagtttcgccgctagtggtgttgtcgtaaggccacagaggtaatgaaagtatttataagaactaaattaacggaacggattcaaatggattggaacatggactcaatatgaagataataatccaataccctcataggcagagtgaaataagagatagttatccattcaccgtctatttgtcgtagacacctatgtaacattggtgattattactcatggagagatatacgggcaacccccaaat

SEQ ID NO: 2453 - DNA, 818 bp, Sanxia picorna-like virus 2
  strain SXXX37883 hypothetical protein 11
gagcttccagtctatagtaagtccgcattgaacggccttatgataagtcttctgaagagttttgacttcaatgagtcgatgtttgagcgaatgctcacatccattttgtgatcacttttgtgatatttgttttaaataaatttaataaataaataaaaatgatatatgttaatatttgagcttggtaaagctacaatattgaaaatacgtttgagcgccaatatattgggtttgagcccttggccgggtgtcgtgattaataatcccatgccccaattgttgttgtttagcgtatttgataattgtaggatagagaccatacagcgctatacttgctgtaaagattatatactacagaagttcgtaaatgtgcttattgtaggagctctggaatatggtgcgcgttaaataggcgcaagtttcactggctttgtttagggtatttacctgacttgatgtatataattgtttatcaacggatgatatggaaaaggtgacgttctcacttttagatcgcagtcatcatagcactcctggaggaggctatagtatatcgcgaagacgtcattttgatatttgacggttaaggcgtaaagaatccaccctgttatagaatagatacgagtcgcacgtcgcgccagtagtgattctatattaaatgtgatcacctccttatttctcttggaggtttctagttcgagactacaggcattcagccaaccccccactttccaggaaacaatagagatttatatatttattattattattataatattcttcattcattcatttctctattgttcctattttatatc

SEQ ID NO: 2454 - DNA, 819 bp, Yonago Culex iflavirus
  17CxIT-T3-H35 gene for putative polyprotein,1
ccccttttcatcttcacaataatatctattatgaatctacactactagttggattttcattgccttacagaatacgtatagtgtattgctggactagatggtgtatgttgatatagaattattttgaagtaaagccccaaacaaagcaaccccgctctcttttagttcttaagtttaattattaatttattttaagttccctcccctattccaatatccctattatcctttagtttaaacaagttgataggcctgggaaccctggagactttgagaaaaacccataatgatttagcaatttcacatggaactgattgagtgactaagtgcctaaatgtaggttgagtttcgacaaaaagcctttacttagttagacaacactccgatgttaatctcggaatttcttgtgacggtttctatatttgttcctgatagtcagacgtatagattctaatgtacaagaccgaagacttaactacgtttagtggtagtatattatacacggtgtatgaacgatttattcaagtaaaagccgtgagttatataatatatatatcagattgttgagcttgatagcgtgcgaaacgtgcagtgattgtgattttggtttatcttgaaaagtatcatagaaaaatattaattattaatgtgctatggatagatgcgctacgccccaaatccttcagagctatcccacgactggcatcgtgtaattaaatgtggtaagttaatatgagatgactcactgtgtgcccggttgctttgctagtttgttcaccgtaaggaagaaactagttttacaaaccttccaattctttt

SEQ ID NO: 2455 - DNA, 820 bp, Weivirus-like virus sp.
  isolate zftfla02pic2 genomic sequence.1
tcattaccttgttgtttattatgataagctagagtcggcctctttcatagtgacttgttttgacgtagttccccgtatcgtagcattgctgatacgttcagttttcgacctaggcatctttaatgtagttcggttgtagattcagataaatgcacaacaaaatggttgtaaacaaccagaaaggaactctttgtttaattttcttaaactttgctaaagttttagttattctttgaccctggctcgttattatttcgcattactagaaagagaaatatgcgtgagccataaagttaatttattaactatgctttagaccaccttcttctgtaacaatatcgcagaagatagtcccgtaaatgatgattcactgaaagggcagtggtaacaccaccgtcggaatgaaccttttaacaggggattgacccgagtccttgacaacccaccatttgtagttgatactatatcctacaccatgctttatgggagcaccatccacggttcattagtagttcgcgaaattgaagaattaaacctgttatgaaaggatttagtaggacacgacctgtcttgatgtcattcgagtaggagccgttaacaatccgaaaggtctaagtaatgcagcttaattccataggtttctgcgggattgtcatttcgcctttctcatctccttagggaccagtatgctggtccctttggagccctttcatagtgcgctgattgctagtaacaatcagtgtactaagtttgggattctttcgatttaattctttagaggaatcccctcgcccaactttttatcatacagtacaacatc

SEQ ID NO: 2456 - DNA, 821 bp, Equine torovirus
  strain Berne 5' UTR and replicase polyprotein 1a1
acgtatctttagaagtttatgaagccttgaaataaaaagctataaaccttattacggttagtccaccacacggctaaattttcagtgcgcagtcactagtcagggaggttcagccctgtcttttacttctgtgtaggaatctgtacagatatattgtctgcatactagtagttacaagagagtgcatttagtacttacaagcgggtcaaaccgccctccggaaaggtgcactttccctcccgaacgtgtgtagaccgtgaccattgtgtctagctatctgtaacaaactatacggttgtattttactcaactttaaggcttttataaaacttgcaagtgccaattttggcatttgttctttagccttttaaacctcacctccctacgggcaggcgcttaagcgactaaacgaggtatagccaattagttgttactcccctccagctttgctgcaggcccttagtttgggactaaagtgagtaaacatactttttggattacatctttctaaactactgccaaactgttgttttatatatttaagttttgcggttttacgctatttacttacggttggcagtttgtttggttgtttgcacaattttttgttataccaatttttactgtgtttttactttttacagttaaggctattttttatcttcttaggcttgttgaattaagtttttccactttaataatttggcttatagaggttttaagaaaaaggaaacaacaatttagacgtcgttctttagacgtctaaattttaaatctggccaataaatatcaggttattgactccttgtggagcgagactt

SEQ ID NO: 2457 - DNA, 825 bp, Apple luteovirus 1
  isolate PA8, complete genome.2
tgataactttgcaaggtcccaaataggtagacgcagctccatcaccttcacccaagcctgacccaaaacccagtcctcctccaccttcaccgaaacccgcaaaggaaaggcgatttttcgcctactctggtataccaaagacgaagatcaaaactaaaggcaatgacgactccatcattgcctcctccaacttggagcagcaggtcttccggtatatagaggcaaacaatcagaaagacgtcacgttgaacgcgcgttggtattcgacttccacagtgaagaacaagccaatgattgtattcgacgtgcccgctggtgattggtttgttgatttcctttgtgagggttacatgcctattgaggcaataggtggtagtgaggaccagaagtggatgggaattgtagcgtacaacaatgataccgcggatatttggtccgtcggggtgtacgacaatgtctcaatcactgagctcaacataacttcctcttggaagcttggtcacaaagatttagagctcaatgggtgtcatttccatgacggtcaggttgtagagagagatagcatcggttcatgtaaagtatcatccaataccggtggatctctctttttggtggcaccatccattatgaagacagcaaaatacaactactgtgtctcatatggcgattacactgacaaaaccttggagtttggttttgtatccatggtgtttgatgagcgtgatggagctaacaccgccgttccgcacattagaagagagctcaagaatgttaaatatcttcggccttctcctgtgcgtctgaacgacggcggtgattatattg

SEQ ID NO: 2458 - DNA, 826 bp, Hepeviridae sp.
  isolate wpk139hep01 genomic sequence.1
actacacttcaccagaaagtgttcaaaaggtcctgccgggtaaacccgacagggccttttgaacactttctggtgaagtgtagtatcgccagtgggtttctccagccaaatctggaggagcgggctgcagcgtgactgcagtggtgtgacccggtaccatgattctgggaaatggtgtgaatgagaagtgtgattgagtgtttagccccgacccactggggtttcgctactgttggtgcagtggttgagcattgtggggtgaaataggggatacttcttttaggagcagtcttttagccatattggctgtgacatttaaattcttaatacgtctggttcttgataccagcgctcatttcttctttctatcattcttctcttactggctgtctaactgccaagagctgctaccgctgcgcccggcggggttaactccaggactagcctggagctgtggccgccaaaaagttagatgctgtgactaaccaggcggtgagctctcctccagtgtccacattgggggtccggtagcgatcggggtcgacaggtaggctacgggtgaaacctgtctgggttactactatgtaggagaaccactggagcgctaagcacgcggacatttgtgagatccaaagtcaggcaaaccagcttggtatgggtcaaaaacatctcaacgcgagtggggcggtgtctccagggccccgcgggacctattcccctggtgtggcgtagctggagctgcgcccaccttcctgtatgcagtactccccttgagggggctaatcaggggcatgttaggttttaaaccacaacagtgttgaagttc

SEQ ID NO: 2459 - DNA, 826 bp, Apodemus agrarius picornavirus
  strain Longquan-Aa118 polyprotein1
tttgaaaggggtgcggatatcatggcgtttctcgccatgatatccgcacattgcaaacccatattgcatacccactgggtatgcattatggggaggcccctttcacccctccccccccaattaccttttccccctctagtaaccatacgctttactcagcgtaactactccgggttacgtgatgaagaagaggctacggagattctcgggctacggccctggagccactccggctcctaaagatttagaagtttgagcacacccgcccactagggccccccatccaggggggcaacgggcaagcacttctgtttccccggtatgatctgataggctgtaaccacggctgaaacagagattatcgttatccgcttcactacttcgagaagcctagtaatgatgggtgaaattgaatccgttgatccggtgtctcccccacaccagaaactcatgatgagggttgccatcccggctacggcgacgtagcgggcatccctgcgctggcatgaggcctcttaggaggacggatgatatggatcttgtcgtgaagagcctattgagctagtgtcgactcctccgcccccgtgaatgcggctaatcctaaccccggagcaggtgggtccaatccagggcctggcctgtcgtaatgcgtaagtctgggacggaaccgactactttcgggaaggcgtgtttccatttgttcattatttgtgtgtttatggtgacaactctgggtaaacgttctattgcgtttattgagagattcccaacaattgaacaaacgagaactacctgttttattaaatttacacagagaagaattaca

SEQ ID NO: 2460 - DNA, 827 bp, Unknown
  Description of Unknown: Bryopsis mitochondria-associated dsRNA genes for capsid protein,1 sequence
tgtataatgggtttggaatccatatacatcctgaaatcgttcattgttgcatcgcgagctggagttatcgcgggggagtttatctcttctagggaaatgatggcgtgacttaagaccgaaaagtgtcgaaaagcgttggaccggcctctgtttacaagccgcctctattatgaatgtgctccttcctctgttagtgtgagagcttaagttattagcctaggtgacgccgtagggtgctctgtgcccggggattgttgctgtaaaagagtactgaagtgcaatcggctcagaaaggctatataagagtgcctttgtcaaacggcaacctgccgcttagttggtaatcaccagccccctggcgcctaagttaagcgtctcctaacccgtggcgtaggtatctaaaaggagctgtgcaccgtatagctggaagtttcggggggtgacgtcgctgtccatgtgacacagtaacccagggtgccttcgcaagggtatacctgtggtgctatcctcactcagtcggccgggttcaactcctttatgcttataccaagatatttcctacattatatcatactatagggtgctagttatagttttattcttaatatatcgataggccaaacattcttagtttgagctctttcgtgcatttttctcacatatgtacatatgtttcactatttatcagaatactcgaaaggtataccgtactgaaaaatcggataaagaggttgacgatctaatatggtttctcaaattggaaggacgtccgaaatgggttagctttgtaatgaagtgaccagggtgaggcatgatgccgccacttc

SEQ ID NO: 2461 - DNA, 828 bp, Beihai picorna-like virus 35
  strain BHZC37213 hypothetical protein1
gggagagaaccatggattaacatccatggttctctccctacatatgattgtgtgtcgtttcaccgcgacacccggcaatcatacatattcattgcagatctcgttctgctcttattttacgtagatatagacgtgttgaataggggtagaacccctaatcgcatttgctgtatttgctttaagagacctatagaataggcaatagcttaatctatagattatgagaatgtatattaatatgatatttagtcaccactccggaaattaaccacttctaagtgatgaccgtatgaatgaaacagttgtggctactgttttgtacgtttatgccgtcaccccagagagtcaactctgagaataaatcacccacttctgcgagaagttgtagcagcctgtaaggacgagctgtgtttcgacttgttcgcatagattattgaatctcatgaactgaagtttaatgactgataattaacgcttgtaaggttttttaatcgttggaatcccacctattagtttcgatttcgcttaactgatctccacccgcagtagggttgaagagagatcatagatctaacgaacttttaggaagaattggtccaccggttttaatttgactgacgtactagtacttactataagtgaacaatatagatttatatatgcacgtttacctcatgacaacctgagtgaggaggtttggtcacctaaatttaccgtgtctctgtatgaattttgaggttatcgatagttgttctactgatgtgattgagatgatatcgtcttggtttgtttagcccgttgaggttagtccctattcccactaaaatt

SEQ ID NO: 2462 - DNA, 829 bp, Hubei picorna-like virus 46
  strain spider133332 hypothetical1
gttacctggatggcgcaagtagaagttgctttgctcagtatacttgttcatataataactaaaccttttatgtaaacctttttatatgtgtttgtgtatgtttattgtgtttgtccctacactgtgtattaggacctctatgtacgttgtcataagtcccacagtaaaacaaatataatatcaggtaattctcatgtatcaatatctctacgggtattggggaagttttcaagttttgggtgccgacgaagatgccgacgacttaggaatcaaaatgcctttatggtcatggggtgcttaatatgctatcatacctcttgcggagcttttaaagccgttcaaagtccctgtatagcagcacctcgtggggtcatgccgttgttttcctatggctagatatagctactgtccttcgttggggaaccgccctctaggcgattatgggtcctttactgatgtggttattataattggttcacaatgttcgagaaatccttcttaagaccgcttaagaatcgtcgagaccgtgaactagggtacacgcgtggagacgttccgttgtgaatcaattataatcgacatggtattggtcatgagagttattgggtctcaccaaccctcggagtaatgtatccgaatgtcctgtaagttgtttttgagcaacctcttcaggaaggtgggtttctcaccaaagaggcggatgtggccggaacccggtgacgctactcaataagagtggggctctgcggagagacgtggtgacaccttggaatagacagggatttttcagttccaaattagctttcatgtgtttgtacaaattaaattt

SEQ ID NO: 2463 - DNA, 832 bp, Unknown
  Description of Unknown: DsRNA virus environmental sample clone pepp.ochl_contig321 sequence
ctcgtgcaatggggcccctgtcccctgaccatacctacccgcctccgggccacctgagtttctgtacagagctcagacccgggggtaacaggccccattgcacgagcaggtaggtctcggggtctacccctgtcgaagttccggcttcggcaggggctgggcgtaagccagccatcagagcgatctggtggcgagatttggcactccgttaacacgtttgtggaggcggagtgttgattcacccaatagcattcttgaccatcatgggttttcacccaccctttccccctagctataggctttggggtaagggtgtgtgtaaaacccctagtagccgattgccatctgcccacacaggctcatttgaaaaagcaccgaaagctctgcggagcaccctctatcccctgcgggatttgaggaagtttgaggctcttgccttgcctccaattgatggaggtggccaaattaccctctgatgggttcgagaggtaagctaagttggcttggtagttaggcggttgtactgctcgagggcaggtttccggctgctacctttaaggtcataaatgccgagagactgcaacggccgcaatagggtagggggacagtccctagttgagttaggtcaactggggtggtttgagcgcccccacaggtaatccacacacgttaggcgagtttttccaaaatatccaagttatccaggtgatcttcgagtgtattccagacgattagagtgtttactccagatttttaaagtgtacttcaagggaatttcgtataacaagcgtaaaaaccgttcttttaagaacgaaccgtatttattgttgag

SEQ ID NO: 2464 - DNA, 832 bp, Unknown
  Description of Unknown: UNVERIFIED: Macaque picobirnavirus 0 ORF1-like gene, complete1 sequence
agatgcatatggttttactaaacctatgcttcaaaaactcgagccatttgtattcaaagtggttagagtagaagcaacaacaacatccgtcacagaaaggaggaaatagtgtgacaagtaatcaattatcttatctagcgaatcaagaaacggttcgacacaatctagccgttgaaaatgaaactcatcgctacaacactgaagcactagctgaactaaatcggcataacttagctacagaacaaagtgcgacagtaacaaacgcaataaacgataacagccagaaggaaaacgctcgacacaatttatctcttgagcagatacaagcattagctcaaggtgaagtcggtagacacaatcaggcgagcgaagagttagctagcagtagtttgtctgagcaaatacgtcatgcgctaatttctgaagatactcagaatattttagcaggagcgcaggcacttaacgcgcaaactaatgcgttgagtcagcaggagacagccagacacaacttctcacaagagcaggtttctaattacactgctatggagcagcaccgccataaccaagcaggtgaagaactgtcatctgagagtaacttgttaagcggacagagaagtttattagactacacaacaaaacagcagaatattgatctgcaaaataatgtccttgatgaaacaaagagacataatactgttaacgaaatattaacaggggttgatcttgctcaacaaattgtaaacaaaaatctcgacagaagagatagaactacgaattccctatttaatggaattttccgaatagggtcaatggtaaaataggagggcatacc

SEQ ID NO: 2465 - DNA, 832 bp, Picornavirales sp.
  isolate RtMruf-PicoV/JL2014-1 polyprotein gene,1
ctagactttctaccctcttgaatggcgaattccagagtaaagtcacctctgccttgccgctatacacacccaaccaatcgattcggccccacgtgtatagccccttggtcaagtgacctcttacgtctggacgcggatttaagacctgaatatccgctgaaagttaacaccatgtttgccccgattatgtgatgtttctgctcttgctgggcggaacatccgtcgggatgccaaagcaatttgtgtccccttctttctttggacttcggtcccccggtcgaagccgcttggaataagacagggttattttccctccttcctctcttctactttgttaagctctatttaacaaaagggtatgtctggcccctcccttcttggggaatgtgcgcggcggtctttccgtctctcgaaaagcgtgcatgccagatgcaagagaaggtgaagaaagtaagttgtgtctaacgttaagacaggaacgaatgtgtctgtagcgacctctcaaaggctgcggtctccccacctggtaacaggtgccgcagcggccaaaagccacgtggttaacagccacctttgagagcggtgcaaccccagcaccacactttcgttgttgttttctcactaaccacaactcgcttctctgaagccctcttgtagagttgccaagaatgtccagaaggtaccccggtccacgggatctgatctggagctccatgcgtgtgctctacacacgttcgggagttaaaaactgtcacagcaactccaaactaggtggtcctagttttcacttttatttgtcaagtcatatggtgatggttaaaggagaacgaca

SEQ ID NO: 2466 - DNA, 832 bp, Shahe isopoda virus 3
  strain SHWC0209c10670 RNA-dependent RNA1
cccggcaaagccgtccgggtgcggctttgtacgagtgggcggtggtagaccgctcgctcgtggcgctagaagtgacagcgcggagcccgacattggtgaaacatgaacgctatagagttctatcggcccacgggccgggcctcactgtccatacgcctgggggtagtcctttgcggacgctatccatcgcgtcaatgtcagtggggagctcggggtgcagggagggtaccggtgttgcattgggatagactgttttgcgcgaaaacgcttgggtgtcgaccagatttatttctaccacaacatggctttaattagcgcgtgtggcagggtctcccttgtttaatctacggcttaggcagctcattggcattcacggtatttactcttatgcattagtcaccgcacgttgaggggcggttggaccacgggtagaattctgggtggtttcatcattcctgaatccggaaacgggaagttggcggcgataatgcctatacgacctgtggcccggggactaaggcggtcaaatcaaagaaaccgcttttccaaagccagctgtcctttagagggaggctggcccacgttgttagtgggtgacatatctttctgaactctgagctctgctcacgtatttttctttggcacacgtagggtccctcccgcttacagataagcagcttaaaacgtattgctaggtagaagagttctatctaaggccacgaaaagtccttcgcgtccgcgagtacggtgcttccctcgatcagcacagcttgaagcttagtatcggtgataccttgaagaaccagagtttagaaaacaacttttaccacag

SEQ ID NO: 2467 - DNA, 833 bp, Southern cowpea mosaic virus
  complete genome.1
gatggtagagatgggcttgtgtgacccggtgcggctttttgtcaaacaagagccgcacccgtctcgtaagttgaaggaagggaggtatcggcttatctcctcggtctcaatcgtcgaccaattggtcgaaagaatgctctttggagctcagaacgagttagagattgctgagtggcaatctatcccttcaaaacccggtatggggctttccgtcatccaccaagctgacgcgatattccgtgacttgcgagtcaaacataccgtgtgtcctgcagctgaagcagacatatctggttttgattggtccgttcaggactgggaattgtgggctgatgttgaaatgagaatcgttttgggctctttcccacccatgatggctagagctgctaggaacaggttttcatgcttcatgaactcagtcctgcaactctcaaacggacagttactccagcaagagctgccggggatcatgaaatctggatcttattgcacctcctccactaattcgcggatacgttgccttatggctgagcttattggttccccatggtgcatcgccatgggtgacgactccgtggagggttttgtggagggggctagggagaagtatgcggggctggggcacttgtgcaaggattacaagccttgtgcaaccacccccacaggccagttgtatgccgtggagttctgttcccacgtgattaaacgcaataaggcgtttcttacatcatggcccaaaactctgtataggttccttagcacgccgagggagacgctggaagatctcgagagagagcttgcatcctcccccatgtggcataagattcagagtt

SEQ ID NO: 2468 - DNA, 834 bp, Aedes camptorhynchus toti-like virus 1
  strain mos172CP87493,1
gagcttacgctccgttgggtatccctctcatacgctgttatgagacggaagggggtgaggtgttttcggattaatagcccctaaatcccaaagaggcttgtgaaacttcctgttctaaatagtcgtttcacaggccggtaatgctggaaggttatgggatgcaaccaccagtccccgcgagggggtgcgcttcggcggtctatagcagatctcgtaccggctataggcgaaatacgtaagtattccctgtatgaaaacccaaacctcctcgatcacaaaccgcctttatccccagattatagggggccctataaggccccatattaatctacgtgtacgtactactgcgagtttcgacttgtgaaatgtatgaatcactgtttactggctggactatcgatcgaggtttcggttatcataaaacaaaaactcagctgtgttttgatcaaatatcaaaacagcggctgggagtacctttcaattattgtcttcgggcaataactgatagttctttgcaagtaactttataggtagcggccttagttagggcgggacgtcctgggtggcgcgatgctggccaaaatctgttcgtcagtgctaaataggagttgggcaagtgcctgcttcttaaacgccgagagactacaacggcctcactgtgggaaaggatcaaacgacgtgatcccatggtgactaattttaggggtatagtccccctctgtgctaggaggggcttcctgcatactctatatctagcatatcgttacgatctttgaattttttacgcgctttaagtcttgagaacctactcttgggaattattttcggataatt

SEQ ID NO: 2469 - DNA, 836 bp, Beihai weivirus-like virus 8
  strain BHZC36478 RNA-dependent RNA1
accaacgccacggcttgcccgtggaatgcattaattcgtatcgttgtaattaagccattttggctaaagtcccaggccttgaggaggaaatgcctcaggggagatgacgtaggacaattgcatacccaggggatgttccgcccctctctccttgtccggggttctgaagggagaaaccctaacaagtcaggcttattcttgacccctcgcttgatgagcgcaagcagggtgcagcctgccggtccagtgggaaggagctggcctgaggtgaaagtcgtgccgaacgcgggttgacagccgcgtagggttagccgccttaatcggtacaggagttccccctctcccgcgcatccttaagggatgtgaccccagcacccaagccgtaatggcgtggaatgttggaaggggaactaaggaatggttgcgccgtgatccagcactgcttgacaaatctggactcatctagcagcaggaatgtgtattctaagccctccgacctctgacgagactatcaaacatccaaggtagcacgtgattaggttcaagtcaagtcggtgaaggtggtttcttgagccccaccttttggaaacaccaggagttgatcgccctggctcggcgccgaacggacagattcatttctgcccgatagttttggccgcgctcgtgtggagtacacattttggatgagatgtcagtgtgcctagctttcgcgagctttgcacacacaacgctctgtatatagtttcacttgtattccgtggaacgtcgaacatcgatggcccacgtggacctgggcgaagacctagttgtcgtctatcaagctttctgttttttct

SEQ ID NO: 2470 - DNA, 837 bp, Hubei picorna-like virus 1
  strain WHSF7464 hypothetical protein 11
gtttatagcgcatgtagagtttttttgaagattgatcaacctaaagttgagagatgagtatacttcgtgtagatacaaattgtgaaccgtgttcgcatatacgcgaagtatatgctttcacgtttcatgcttttgtctgcatgagttatatgtcattatgagaatgatttagtttgtctcggtctttgaaaacgtttttacggttctagcagaaactaccctcgcgaagtagggtccatctgtagtcctttcggacaaacgtgttaaccggaacacgtcgtaatgttgccttaattggcattttcacgggcttcttgacttttgctccggagcatcagttatatagaagttgggtctgacgagcccttcaccatagttgtgtacgtcttagatatacactacttgtccatatgtttggacaatacatagtttatggtttagatatatatatctatgttcaagctgtttgtcagcccaagggatcacgccattgatcctcctttaatatgggtgtaaatttcttcgcactttggaaacagagtgcaagtattggcaaaaaccctaagcctgtgatttgattcaggatagccaaacgatcttcaagatcatactttttcagggggcgaaatacccagaataatcaatcctgcccgggttcgcaagaacacggggtgttaacctcatgcaatgtacaagcgctgaccttcgctctctgcttggtacttccgacgccgtcattggttaggacatgtggtgctgggcaaccagaaatgaatcccaacacgggattcatggtttctcagcattgtgacatcttgtttgcaatgctgatttatc

SEQ ID NO: 2471 - DNA, 840 bp, Scaphoideus titanus iflavirus 2
  isolate St_USA, complete genome.1
cgtattttgaccgtatcgatctgtttatataatagcgacgtattttagtgagaatcgtttccttatataatatagttgatatgtgatatagtcaatatacagaagaataattgtttcctggtaattcatagcaaagtaaaatctgtccctattgtctatactagttttaagttttagttttaagacacctttcttagttttaaattttgtttgcatgttaatgttgttgaatctgcgagaaaatgttgattttgtatgaatgaaattttcctattaagttaggtccgtttgtgtttgaatgaagagtatgtattagtatgtttgtttctattcctaatccctcctttgtccttgataatctttattattagtaaattatgtagtagaactctaccggaattcgattttgtatagttcttacctgcagcggttagatgaagaactactttttctttaattattgagctcagccctgtgacgttgtatgagagtatgcttttgcattatctttactgaacgcatctatttttataggttacgatttgcgtgtttatgcattatgtcggtttaaccctataatagaagagcgttgtaatagagaagcattagaacttccttgtatgattagaatcagatcctggtaaagcaataattatagacgaagtaaagtacaattgacatgccccggtagtgaccttcagacaagtccccctctgaagttcgaatcattttctaaagtaataaagtattatcccttttcctctttttatccttggattgatttctttatttggacacgaccactgcttgtttttatgactattttgaatattttatgat

SEQ ID NO: 2472 - DNA, 840 bp, Beihai weivirus-like virus 10
  strain BHZY59101 RNA-dependent RNA1
gcggagcatgcttgtggtgtgttgagccattttggctcgcgctgtgtcgctaattagcattttgctttaattaaagtcccaggcctcagggaggaaatgccctgggggagatggcgtaggagtgtgcatacacggggatgttccgcccctcgctccaactccggggttctgaagggagaaaccccaacaagcctggcttattcttgacccctcgcccgatgagcacgggcagggcgcagcctgccggaccagtgtggagctggcctgaggtgaaggccgtgccgagcgcgggttagccgccgcgtaggattggccatccttaatcggtataggaggggcccctctcccgcgcatccctaagggatgtgaccccagcacccaagctataatggcgtggtgtgttggtagggcctccaaaaagtggttacgatgtgtcccagcactgcttgacaaatctgggcgcacctagcagcagcagcacgtttccaagcccgccgacctctcacgtggactatcaaacattcacggtagccgttgacccatttccagtcatgtcggttgtggtggctttggcttgagcgccaccattaggaaacaccaggatttagtcacctgcctgggcgccgaacgggttcgggattcttcccgtccgccgatagttttggcccagatgtgtgggaatgtgctgtgggtgtgggcgaccttcgattattgcgtcgttggtcttttgctctgtaaatagcgttcaacttttcgtggttccataagcggcccacgacgacctgggtgaggacttagtccgtgctcacgccgttgcagtgtgttagcatctcttccgcg

SEQ ID NO: 2473 - DNA, 842 bp, Shahe picorna-like virus 1
  strain SHWC13622 hypothetical protein 11
catgcacagcggttttcccgctgtgcatgtgtcttcacgttgatttttcttcgaatgcgtttattcgcattttgtcttttgaatcaactcgtattgtaagtgcaattgcttgctgtgatatttcgtatacacctatagcctttgtgcacgtgtgtagacgactgtttcagtatgtttgaccattttcaatacaaacaacaagttttatgacatttcttgtgaacaaataaatgtcaccaccctagagcattgctactaagctttgttagtagaagttgtttagagtcaaaacgacggacctctatttagagaacccgtgtccgatggtgataagaactttaatcgccccgggtgagttgccctcacatctttatgatgtgtagggcgctctcggttagtattgtggtggattttataaatacgtcagatggctcgacgttaaagcctatggttgtgaatcaaccagcagaagggaaaagccaacccaaactgctttgttaaaaactttgccgaatgcggaagtaccgtgaagcaaaggacggtaaccaaacttacatgtgactgcgacggaatagcatgtattttaatccaataacgttcaccagcccaggcgggaacctgagctcaaatttatttgactcgttggttaacgccgagaaacataatcaaggtgatatgtccatgaagtgggaagcttgcttcctgtgggtatctcggaaagtttggcccggaatttattccccccaaatgagtacaccttggtcagatagatgaagtacgcactatttttagtgcgtgtttcttctatcgtgtttcatggctatttatcatttaaatagatc

SEQ ID NO: 2474 - DNA, 846 bp, Chaetoceros tenuissimus RNA virus
  genes for replicase polyprotein,1
gaaatatatattatgtatttcgtgctctttagcactgatctaagaaggatcttattatagattgttactttgtagcacaggaccctttttagggtcctatgttagatcgtctaactttgtatattaagatgtggacatttcagttaactattgaattacgtattatgtaatcttggtgctccagattggtaatctggagcttccattgtaacttagaattaataaatatctaaaatttaccaccttgagtgtttattctacgaatattcactctttgctctcagccttgcgctgagagcttttgctccccatttatggggagctttttgctctacacttttgtgtggagctttttcctgcctttatggcaggattttcgatgttttatctgagtcgactacggtcaagtgtttatactcagacttatcatcacctatagaaatttcaaaaattttattagttgaatttctatgattcgttacctttataagaatggtttcgtatgttcgaggaatcccctcagtactatttagtaattttgtttattaaaatctccgacgaaaggagagtttatcagaaatagaactttagtgccgaaataatcggtcctcggctacgttttaagcaacgtatcgctacatttatattatattaggtattcgcaataccatttagagattatgtatcgtttaagcatcagttaccgctggtgtagggtgttggcactcccgacttttaaatacctctacctcttttgtgagccgatatcactagattttcgtaaactactattacgattgttttaaatatagtttttcaaacacaacccccctcttcacttttatc

SEQ ID NO: 2475 - DNA, 846 bp, Renmark bee virus 3
  isolate SA-4 nonstructural polyprotein and1
cgtatattctaccattttggtaggatatacgtgagtattagtttcgacctttacgggtcaaggataattttaaaccttctttatggaggactgaatttgattgcacaattgttgtgaaccgtaaggtcatttcaactttgtttatatcaataagtcacttattttgatttgtttttaaatgtctttgatcatttaattctaaaatagagtaaactatattatcaaatctgtacgggtcttttcagacccaaataactaaatgaaaccaacccttttatgtttatatgttgtagtgcgtttattttacacgcattgtttttataagtaaaattagttgatattaatctgcctttcttaagttcaaatcttttagatacctctcgtcggaaagacagcaaattaattattttctattgttgaagtttagtggatatgtacttcttgttttccaaacatccatcataaaatattataaaatatgcccctaaaaagagccaagtattgtttaatacatttagtattgtttaactcatttatgtttcttttgcagaaaactttttataaaattactacacacagaatagaatatttctggtgtgaaatctattagcaaatctcgcaaacgcctctccgttcttttatggacgacgcgaatcgtgtagagatgataagttacagcatcagttgatgccgaggactatctagcaagttagtaaccctgtgtggaaaattttatattaataccacatcaaagtaagagtcttagatgtatgttccagtgcattgcactggatatccttagcacgggagaaataaaactgcaccccaaaacctattagtacaacc

SEQ ID NO: 2476 - DNA, 847 bp, Kummerowia striata picorna-like virus
  strain pt119-pic-7 genomic2
gtgcaacccctcatctcaaccaggtgatttgaggtattttaattcctggggttcctggcgaagaagcacaactctcgccttgataccggtgtcggctagtagatccgatggttcacctggtgcgcagcccgttccttaaaccatttaatattgcaccttgtaggactgagccctcctgcaagtagtttagtggcttactgaagaaacatttcaaaaaacaaacttaggtgtctacaatcaagacacctcaacccctgttgttcaaacaggtacaacgtcatttgtggcagatccggtgtcggccatacaaagtgttggcaggtcccaagatgtgtacgatttgtacacgcctaatagcacaagcaccattgccgattacctggctaagccatatcaagtttttgccggtactttcactgttgttgattcaattggagctattttgtatgcttcagacacaaaaccgtattatacaaattcattgaaaataaataagttgcaaggcttctttggtttgcgttccactttgtgtattcgtctggatttaaatggcacgccttatcatgcagggcgtcttcgtttatgttattatccttgtttttccctcaatgtgaggaaggggagtgctcacatcacgaatgccattcctttgtctcagttacccggtgttgacattgaagcaaatgagtcgtctgttgttctgcgtattccgtatgtagctacgtcacagtttatcgaactgactggcggagcggtcgactggggtcgtgtatatattgccgtcttgtccccgttaaggacaggccctgacaatttgctcgaggttaattaccgcgtctggacatgg

SEQ ID NO: 2477 - DNA, 847 bp, Shahe picorna-like virus 2
  strain SHWC0209c12507 hypothetical1
gggggacacacccccacgcacaccgtagattaattgagacatcagttagtcttgttggaaccagttgtactgtcttttggagagttacgactctcctccagaccagacttcatgttccatcgcacttttctacaaaccattattctgaggttagccacctcgtgcaacggctcatagacgcatacatgctcagtatacgtataaaatctatgttgattttacagaaaaacatagtcgctattatagcgcaacaaagctaaatactagataatttctgtattattagaagtatttattcctatgaattttaaaggaacgggcggcacccggctatgttggtttatgttatgtttatttgcgcactccacgcaagattatttaaacatgtcctgtctggacactttaggttgacacctagtaatcggtcgaattgataattcacctattacaacatcgaactcattggagttccatgttccgcttcgtttgaagcaatccggagtgaggcgtttatttgcggacctgtcttgcagggttatcttaaaggataacgcaaatgattaggagtattgaccggtactcagtcggaattattgtagataggtgtggcaacccatgacctacaataagctactggaatgtgaatacgttgtcgggctacctctcgggagaaatcgtgagacttacgcaataggttcgaggtatccaaaaatccttactagtagtgacactgttgtgtgtcttgctagtgtaagccgtttggtaacgactattctgtttggctgttggaataaatttgagggacgtgtgtaatagtgaccacgcaccttttatctttgatatcgca

SEQ ID NO: 2478 - DNA, 848 bp, Potato virus M
  isolate VIRUBRA 4/035 223K polyprotein-like gene,1
catcgtgtgttttcaacatgcggtcctgtgtcgttttgcgccctacatgcggtacattgagatgaaagtgcatgaggtgctaccaaagaattactacatccactcagggaagggcctggaggagctggatgcttgggtcaaggaagggaagtttgacggtatttgcacggaatctgattatgaggcattcgatgcatcgcaagatgaatttatcatggctttcgagctggaattgatgaagtacttaaggctgccaagtgatctaatcgaggattacaagttcatcaaactagcttggggtctaaactaggcaatttcgccataatgcgcttctccggggaagcaagcactttcctgtttaacacactggccaacatgttattcactttcatgaggtataacatacggggtgatgaattcatatgctttgctggggacgatatgtgcgcgtcgcgaagattgcaacccacaaagaaatttgctcacttcttggacaagctcaaactgaaagcaaaggtgcaattcgtaaacaaaccaactttctgtggctggcacttgtgccccgatggtatatataagaagccgcaactcgtgctagagagaatgtgcattgcgaaagagatgaacaacctgagcaattgcattgacaactacgccattgaggtggcgtacgcatacaagttgggggagaaggctgtgaatagaatggatgaggaggaagtcgctgcgttctacaattgcgtgagaatgattgtgcgaaacaaacacctcatccgctccgatgtgaaacgagtatttgaagtgctttaattagtgtagcttaggtattgctattgtattgaatattt

SEQ ID NO: 2479 - DNA, 848 bp, Picoa juniperi mycovirus 1
  isolate ANK_VIR-89, complete genome.2
ggtgcaggaaaactttttcccgacgtgtccaaaatttcctatctagtgatttcgatattaatactcctgaacaggaggccattcgacgcatttttgtttttaccaactataaaaatgacgttgaaaaatcgaaattacgtaacttatccagtgaacgatgtactcctgctacgtttacttcattggatgagtcttttctttatgttgatttttcttccctttcaaaatctctcaaaatcaccagggaaccttatgatgcagtatctgcatatattctttatttcctttttgatcctattcctattgaagtatggaaattcattcctacaacaatcttttggtcagagaacttatcaattccattttcacaaaataattattctaatagaagctatcccacgcctactatcatttcgaaattccgtgaattatttccttctccaggcggacgtgcttatgaaaaatctttcattttacctcatgatgttctttcctctcttgaaaaacctaataaaactaagaatctctacagactcatatctcgtcttcttcatgtgaaatgggagcctaatgttgtttctggtcttttacttgcttgtatttccttgcctactttagatttgttctttaccatcattattaattgggatgagttttggcaatgtgataagaaacaattagttaaagtgttaaaggacttacatactgggattcgtcttacattcagtcttccaaacggagttaggttgacctcagaacagactagacatcactacggtctcgatgcactctacggccggtccgacactttaactaatttttctgcaaaagatgaaattgctcaaaga

SEQ ID NO: 2480 - DNA, 848 bp, Phytophthora infestans RNA virus 3
  complete genome.1
tgagatttacgcgcgagcgtagatccgccctagacgagtggtccaactggcagttaaagctagccagggactgctcgggtcaaagctagtcagttgccgagtggcgacggcggctgatactagagaaggcgacaccaagtgtggacgctgactcgcacgaccttaaacgtcttgggtgcgcgtaactgcaggttttggcaagcttgtagcctagcgtgagcttcagtgtcatggttaagtcaagaacataaaccggatagcactggagccgaaaggcgattacccgtagaagctggctttgccggtgtagtgttctggtatggacacgctaggggtgggtcgtcggttgtttaacgcgagtggggtatgctaaagcattaaccacttgaggcttagcgtgaaaaactaagcccgcgaatgaccatgctaatcggcaatagccgtgtagttgtgcacacaactatgtcacaggggtggccctgtataccggtatcttcttacggtatactaccaagttatgttaacctgcggtgcgatgaataagtatcagaagcagggtgtggcagcaggaggaattctgttgttgctaacgtacgctcaactggcctcacggcagcgggtaagaaccgtatgagttgggtggaacgtgccttgggcgatagacgtccagggtggaacggccggataacttggggaagcagaaagctgcggggattgaatggcctgcctacgggtgcctgatagtgacggaacatattggataacgttaatccaattttcaaataattaacctctccgcagcctagcagctgggatacatagcgggttaactactattaacgataaag

SEQ ID NO: 2481 - DNA, 848 bp, Beihai picorna-like virus 25
  strain BHJJX20433 hypothetical protein1
gtcagacgttaatattactttgtttaaagagtcttattattctcgttatctaacttattattcaatggtctccgttcatatagttgcttatgctatatgttccgcgattttctgacctaataagatgcttggttaagaaccataaaagtccccgcataggaatggggtggccttagggtctctacaacaacggtttcggcatttgctgagcccgtgtcttgatttgatttgtgaacgcgtaatttaaattttaaaagcattctggatcaaatctagttgccaattgaaatttagttaaacgcatattcattttttattcgaggaagaactatgcattgcgtgagtgtttccgcaaaatgaattggtgggatattccccatcacccaattctaaatctttacaattgcatgaatgtgcataaacacatttgaaacttaatgagtagcattagagtttaaagattgtggtttataccactttataacagtttgttttacaaggttagatctataacggatttccgggggtctagcgcggttgccacagactcaacatcctttctttttggaaatgatagtgtgtttgttagtgtacattactacggttgtttttatttaatttgggaccaacttttgttgaacttacattgatttacggatgtcaaccagttacaatttctttagtctgggagatagaacgccttgtaagtagactaaaactacagatcgggggcgcggattaatgctatcgtggacaatgatgtgtttcattgatttgtctggaaactttgtttcttccccttaaaaaccggcattccaactgcttttaagcatagtcgcgtgcagaca

SEQ ID NO: 2482 - DNA, 850 bp, Picornavirales sp.
  isolate ytb135pic02 genomic sequence.1
atagtttcactctggaggttacacataagtcaatttcttgaaatacacataacatagacgtgtcaattagcagatagaaatatggctttatgtgtatatatgtaattttgaatttgattgcgtgtattgtccattttctacagatagggactcaataattttgcagtgcgctccatctcccattagtgctgtataaattattccttttcctttttcccttccctttggatttataatgtgcttatgtttcacttgcataagcaaacttaaaattatatattgtattgtgattttccaatagtatataaatttaagtagacaagttgtgaacttactcttcggagtattttattctcttctgatatgatttggctttgtattttttcggatgtttgatatggcatgtgaactgattgaagggcttcggcaatatgtgaggatctgtaatggtatccaaatattctgatagtattacgcgtggcgaattgagatgtgacttattttaaaaagaaaactcactcacacatcactacgagtcgtacgtaattaactaaccgagttgtcccccctgttcactatcggctaacctgatgcctccaggcgttccgtcggaaacttcatcgctaagcctagcggctgaaacttacaatcaccctttccactgttttgttattgcctagtgcgagaaagacgcttttagatcgtgaatctataagctggagtgaagtacgcgtgagacatgtgttctgcgtatgaaccttcataacaaaattagtggtcggctattgacagtaagaccttcagtgactgcgaaaatggatcaagatgcccaaccttgaccaattggctg

SEQ ID NO: 2483 - DNA, 851 bp, Hubei leech virus 3
  strain SZmix63518 hypothetical protein 1 and1
atataattgattgatttcaattatattcgtttgacgtgttcgcacgttgggtgaaaatcctgtttccgagatttatatatgtatttgaaccattagctcttttagttcaaggtacagctaattctggcctttgttctactaaacaagattgatttttggattcttttaaggccttttcgtacagctcatctgtgcgttgacaagcttgaccgatgtttcaatgcattttatttttcccggaacagacataaccctgtttctacagcagacctatctgctatatcaaaggaaccccctatatgtttacagaaaaatattccactaaatgtagtgaagaagaatgccccgttggcactcttttaacgggaggacataaacctgattctttcaggcctgcccccccgttttacgggaggacataaccctagcttctactaggcctgcccccccgtgtatcagggcccctgccctgatacctctgtttttactttgaggcatttgtaagacctcaccagattcatattgttataaaaatacgaaaataacaattcctcaatatgaacgttccagattggaataaaaaataatctataccctttggtaatttatgtcgatctaagtttaactcgttccactttgtttggttttactcactgcaatctatgatgttcacagtataccaacttatgaaagcgcttgatactttatcgcgttatgcaccctagtcttttgtgacgccggtttgacatttcgacatattttattaaatacttatcaggttaaagtccagatatatcccaaggaaggggagaaataatactccatttaagactcagaattacaattttaag

SEQ ID NO: 2484 - DNA, 853 bp, Morelia viridis nidovirus 2
  strain F17-700-11, complete genome.1
ggtatatataatatacctccagacagtgatcctgtcaattgtgaaaaccatatttgttaaccagttaaataactgtttgaccgcctgctaaagtgggcaacttgtttttgctaaaccccaagacagtttagatcagtccaatttaatcaaacaaaacaattgaaatattttattttattgtcagagtagttaactgattgtttgagaattagtgtaccagcacaaccactcagccagcctaccaaaggcccttggccacttcccctctcacgacttataaaagtcgccacccagataatctacgaaagtagacatcactcctatttccacccataggcactaggagaacaggataaccccgaaaggggcatcctgcctgtgtctctcacattcgctagccagatatcttcacagactctgctaggcttgtgacccagtccgttcccaaagaccgttacctcccgagtagcgcttaggcgcgaaagggaagggagtacctcccgagtaagcgaaagctgaaagggacgggaaccacggcaagactaatcttagtcttacagtgtgggcaatctggtaattgtccccaacaatcaacccaatttgatgtgaaaacatctaactcggttggcttctaactagctataaactaggatatctcttaacggagactccgaggagggccaccaacagtccaccagtttatagtaagcaacaacaggggcgatcttccaagacacctctcaccacaagacacaacaacagtcttgtgaagccgacaatattgtctacggacgtattatcgagggttttaaaggaggagttagtgattaaactaatttcaacaccaataact

SEQ ID NO: 2485 - DNA, 853 bp, Scaphoideus titanus iflavirus 1
  isolate St_IT1, complete genome.1
atttgttcgactatacaatagcaacttatctttgtgagaattgtttccttgtttagatcgacttatgttggatgtagtcaatatatacgagaataggtgtttccttgattttattcgtttagcttagcttctcgcgtaatttcaatagcatggtaaaacgtatccctgttgctacattttagttgttaagttttagtttttaagaacaacttttaatgttaagaaattttgtttgcttgttagcgttgatgaatctgcgaaaaaatgttttcaagtatgaatgaaattttcctatttagttaggtctgtatgtgtatgaatgaagtgtgtgtattagtatgttttgtttctaacctttacccattcctgttcctttgtaattcttcctctacaagtaattttgttagtagtacttataaagaattcgatcgtatatagaccttacttgcagcagttagatgaaggtctacttttcgattagaaattgagctcagccctgtgacgatgagtgagtgtatgctttaatattatctgtactgaacgaacttaagtatataggttacgatttgcgtgtttatgcattatgtcggtttaaccctatcttaagagatcgttgtatttgagaaattttagttcttcctcgcttgtttagaatcagatcctggtaaagcaatttctttttgcgaagtaaagtatatgtgacatgccctttatatgacctcttgaataagtccccctcaagagtatgaatacattatgaaagttttggaataattaccctttcccttcttttccctcgactgttatcttttggacacgacccctgctttgtttaattgattttatagcaaat

SEQ ID NO: 2486 - DNA, 853 bp, Hubei leech virus 4
  strain CJLX30730 hypothetical protein 1 and1
tgtatatatttgattaactatcaaatatattcacgttttatgaaaggatgttgcttttagcaacatctaggaagtagtgcttacttctgacctatagcctggttttggcacgaacggataccgtatcgtcataatgcaactgggcctttatggtaccgcctcttatcattgtacgataatcactcgaacaaaccaactatagtcctggcacgtgcgtatgcatgccgtcactatgcagagggccttgaaggtaccgccactagtcattgtactgtaattacacgaacaaataaagcacaaccccatttaagttccctattcctgggttaaggaatgacgaactatcgtctaagcaaatagtgtgttgataatcactaaactatcatccccccttttttatgttaaatgtcaggtgtttcctgaccttcctcacaagggaatgcgttcttaacaattttatattgttaaacacactagtctttttagacttttattatctggttttatgaatactttgaccatgaccccatactacagaatgcgacgttcgcgtttgctccatagtatgtaatttcaaaggtatgttgtgggtttccaaccctccttgttttacgcgttttgccgaacttgatattataataacaaatttccatgtgcctgggtgtacttgaagatggaacgatgaactgtttcctatcacttcttgatataccccgcacctctgagttatttttaaagaatattgtttttagcctttatgactgcaaagatcagcatattgtttacgttatcccctatgtatgttaagggacactattaattgtagaaacaagtaacatatgtccatgacgct

SEQ ID NO: 2487 - DNA, 853 bp, Beihai picorna-like virus 32
  strain BHNXC41402 hypothetical protein1
ggaactccctgtaggcctcaaagcctacaggagttccctagagaaagtatattgtgtcgtttgaccgcgacacccgatatatgctttcacagatattcggattttatattccttttcaatgtgaaaaacattggcactggtaagtgctgtcgttactgggatgtgaaatcccggttcgtagtattttgctatatgtgtttaaaggagtctttgtatgctgctaacgcggcttcatcgcaaagtccttatttcatctgttatatttcgtcaccacccttatggtcacccgtaagtgatggttcatcatagattctatttgtggcgagtagagtttattattgatgtataccaccccggagagtcaacttcgttacgaaaatcaagccccttgcgctatcatgtattaggaaattgtaaggaacgtttcccgtattacttgatagtgtcgattgatgctaactcataagattggcttcatttgaggattatttatactagatggtttagtattcgtgaagaatcccactcacattatatgatttcgcttaaccaccttcactcgcagtagagttgaacgaaggtgtagatctaacatttttgtgagaagaattggtcttctcggagctatttgctcaacgtaccgagacattattgatgtatacaataccatattttacaactacgttttaaccagggacaacctgacctggagagtttaagccactcaatttttccgtagctctgtctgatatgtgaggtaatcattactcagaagaagtttcaactatgatgcagtagatatcgtagtattgtttagcccttgtggttagttccctattcccattttgaaatc

SEQ ID NO: 2488 - DNA, 854 bp, Beihai picorna-like virus 33
  strain BWBFG40845 hypothetical protein1
gggagagaaccatggaataactccatggttctctcccttacatatgtttgtgtagtgtaccgcactacccggcaaacatacatattcattgcagtacttgttctgctcttattttaaaatgcgtaaaggcgtgtcaaataggggtagaacccctaattgcacttcctttatacattataagagacctatacaattaccgaaaggcaaatgtatagattatgagaatgtatattaatatgatatttagtcatcactccggaaaaaactaattccgtaagagatgaccgcattgtcagctatagttgtggctactatagcatatgtgaatgccgtcaccccgtagagtcaactgcgtcattaaatcagcaccttctgtggaaaatcatagtagcttttaaggacgagctatgttttgatttgtccatatagaacattgaatgttattgtatgacattggatgactgagatttatgcaaattgttttgtattcagatgagaatcccacttttagtgtgtattactcgatttaacctatttccacccgcagcagggttgaagtgagatagtagagttaacgccattcgaagaagaattggtctcgtgtgtgtactttaatccaccgatatagagctatgtcaataagcctcttatgtggagctctggtatacaatatgcgtttatttaagtacgtttacctcatgacaacctgagtgaggaggtttggtcacctaaatttttcgtacctatgaatatttcgctgaggtctcacacagttagaaaatcgattgctttagcaggatttgttcttagttttgtttagccctttgaggttagtcctagttcccatttaaatc

SEQ ID NO: 2489 - DNA, 856 bp, Weivirus-like virus sp.
  isolate war204pic4nc genomic sequence.1
atgcctgaaaaggagtggtgaagatccaaaccatgttgatagtgccttgtttagcctcggagagcagttggcgactgtttgcaagcgaatgtttattatagtatttactaaagtatcatgtacctgtatcgtttacgttgggtacatagaagtggcgacgattcctgccttgtacttactatattagatttagcccgaagtttccgttgtaagatagctacttatatcaatccaaatataaatgtcccctttattttttataaagagtaatttcccccataccgctgaaagtgtctacaggtacgaacgttattaccagaatttattttggattatgcggaatgtggagtgtttcatgtatgtgttgctctatttactgtgtgaatgtgtgcgtatgtgacaggacctcttcttaattgaagaggacagacgagccaacttgattttcttgtaaaaacatttactgaaagtgtttctatctatgatttctacaactaggacctgcccgtgtagcctctggctagtagaattctccttcgcgagttttcgaacgctaatgcctcgtgtttgactcacttaagcctgatgagactttcgatttctctcaggagggtgttttctctctgatgttgagcctagaatgataagatagaagtgcgattaagacctgttttcggattattgacggaaccgttttccttgaatgtgattgagtgaagttgtctacctaacgccaaaaggagccatgtcataaactttgtttggccaccgatttagttaggaagttaaactctatgtgttcgccttaaccggcccaaaacccctttttgctggcgagtgcccaaacccttaaaca

SEQ ID NO: 2490 - DNA, 856 bp, Changjiang tombus-like virus 15
  strain CJLX30583 hypothetical1
ctggtggcctgtgtgcaattaattctttgtgttcatgcctcatcagcattgaacagtacttcaatattttgattatcaattctttgcacaccgcccaatgtatccagtgaaccatggctagacagcggattgctttgccaactgcggacgtcatcgtgccgagacgttaaaacgacgcatcgtctactgccagcaccgatgttaactgtgcaggaccccccagacaaaggaaaacatgagcgcactcgtacgtggattaaccaagtacgcgtgtgctggccttgccctggccactgtctatgctgcggatcaattggtgaagaggttccaccggcgacgcgctttgctgcgtgatgctaaggaggaccttgcagccctcaattcgccatcagtcatgcgtgggcctggtcttgaccaggtcccaggggtggtcactatgctggagcgccaaggcgttgctccagtggccgcctcttccaccactcatctcctccgaaacaaccataagtacttctgtgcgaagtgggctcgggcagtgaaggctcgctttgagtttgccaggatgtgtgaggacaccccccttaaccgtgctgctgtccataggtggctcctttctcagtggaaggagcttaagaacagcgctgggaaggggatgccgttgcatgtcatggacctttacatgaccgatgctatggacatgagcttcctgccaactgccgaatatatgcagagtgagtctaagagggcagttaggaagcgcgcccgcatggagtactacaacgagcggaaatttgtggagggatggaaataggggggcctagtgagggtaagggggtttgataccgtcccgcgattt

SEQ ID NO: 2491 - DNA, 858 bp, Beihai weivirus-like virus 3
  strain BHZY60776 RNA-dependent RNA1
ccatgccagaagacgaattcgatgttggccccgttcttttggggcctcatctgcatttgaatttattaagggagcgtcgggggaggaaatgcccccggtggagatgacgttgtgcgcaatatgggttgggggttcaaagcatcacccacccaggggatttcaccgtctcatccgggcctgcgcactgaagggggccgcaccccgagtcagccttgttcttctgccacgtgtttcactgtgcacggggtgagagcctgtagcggcgtgtcgagccccacgcctgaggtgaaggcttataggagactggatttcacccccagtttaggattggcctcctttaactcctatacccgagatgggcaatgcggtaggcaccccatgatgccccacatctgttgatgagttgttctttttaactctctcagatgggcgtagggatacggggagaagtcgaagctggccgccaagccgcaaggcgtggttggttggttacccatcctgtgttgaatggcgcggtaccgaggcctggcgtatccaggtaatgctttcaagaacatggttagagcctcgacggttgaggaaccggtcaccgaccaccgtatgagccagcggggaacccttcctgttccaggcttgttcgacccatgtttaagagagtgttggtgtgtatagaaatcagtgacgatgcaagtccgagcaggcaacaaaataaaagtaaaatatgcctgctcgtccattgtatagttttttccggacctgattctgtatgaacaggcacaagcgactcccgcttgagacgtgtatagtttttccgaaacgtcacagtagtgttcatccgagtgtacattctttaagaga

SEQ ID NO: 2492 - DNA, 859 bp, Beihai picorna-like virus 15
  strain BHXG24735 hypothetical protein1
cgcagataaagaactccacgtgcgcgtttcgcgcacgtggagttattgttgtatttggcgtttgactacgcccagtgtacttgttatgtagtgagttggggcgttacgacgccccctcttcctgcattagcagctacattgacttcaatttcatctttatcatacccgttccctgggatagtgggaccccctctgtcatgaggatagtcatttctgacgtaagacagacgtatgaagaatgacatattgaatataggtaacattgacgaactatgcctctaagttcgaatgatatgtttaccgaattgatgtgtaccttcttttgaaggcacgtctactttcttgatgagaccgaccgaaaggcggcacttgattgtagattcacattttatgtttctcgtgagagaacacaattcggtacaggtaagactgacctgtctggcaatcggtcagagattgataatctcgactcgatttgttgtgattttgtattgatcactttagcgccgagaaggcgtttgcaccgagagtaagcggtacgagacatgccctactagcatgggccgacgtaatggtcaagtgaaacttgttttaggctatctgttccggtagtcacgcagaattaagtgtactgaggggtggcacccgatgaaggcacttttgctactttgtgtaaacaaattctaggacatcattttgatattttgtcaataattttatcgctatgtttggggtatttacagaaactctggcttttgccgtaagacgatttatgagacattatttgagacttgatgtaagtgattgatcttttgatcagtaattcgagggactacgttccttttatcttgaacacagc

SEQ ID NO: 2493 - DNA, 860 bp, Wenzhou picorna-like virus 53
  strain WZSLuoI86067 hypothetical1
gctataggtctacctatagcaagtttcattcctgaagcagataagcctctcgaggatattaatttgattttatgttacactgtatacactagatgtgggtgttgttactcacacactagaagacggtggactaaagattttattatatattgtatacaatcaaccccaacctattggttgaaggcttccagacgttttacgcctagctggcaacaaattagtcaccagcgatccaaaacgaatttggagtgggtttgacatcccactaagaaattgtcctgcatagcagggaaactaacgtctggccaaaatcctattattaggtgcgcagcgggttcgctttaacctgccactcttgtttactgtcagtccgaaagagtaatagtcggacagaatatgtcaatgaattgaccggaatgaggaccaagttgattgagcctcgccctccgaatgggccaagaatattttcttatattcccacgtatatacacaatttagcacaatagtgtattaacccccttattgttttggggcattgaatattgtgtatagactttgtcatagagtcacacttgtggatattttctgctcgaaacgagtagatagggagattcatcacacaacctggataatcttttgattataaaccatatggaagtgtgggttgaagctcaagtgtgactggtctgagagcgtctatttgatcagtagacagcgcttgatgaagaccgcagttggtggattaacaaccacttatggtatatggcaacctgtgtgaacagtttctttactctgatcgtgtgcttcgtgcaccagggtaaagtattgtttgacaggacttgggacttttctatacaaaa

SEQ ID NO: 2494 - DNA, 860 bp, Beihai weivirus-like virus 9
  strain BWBFG39428 RNA-dependent RNA1
gcctgcgcctcgataacagtggtattacgtttcaccccgtgttgcttgcatttaattaaagtcccagggctcgaggaggaaatgcctcgggtgagatggcgtagagttcttataaaacaggggcacgttccgccgtcccctcctaactcggggttctgaagggagaaaccctaacaagccaggcttattcttgacccctcgcgtgatgagcgcacgcagggcgcagcctgccggcatggtgtaggagccagcctgaggtgaaagccgtatcgagcgcgggttagcagccgcgtaggatttgccaccttaatcggtacaggagtcccccctctcccgcgcgctccctaagggatgcgtgaacccagcacccaagctgtaatggcgtggcctgttggaagggggactaaagaatggttacgatgtgtgccagcactgcgttttgggcttcggttcattacaagacaaatctggacatgcctagtagcaagagtgcgtactctaagcccgccgacctctcacgttgacgtcgtactgtggttcgcccacggacgcagctgatcccgttcatgtcatgtcggttgaagggtggtttcttgagccccacccgtggaagcaccaggagttgatcgcctggcgcggcgccgaacggggagtttgctcgcccgatagttttggccgcgcacgtgtggagtacgtattttgggcatgctgctgcgtttgaggatagtcccattcgcaccacgctcttccttaagggaaatgaattgttttagttatgttgttactgtttttccagtgatgccattttggcacacgaagacctggagaggacacagtcgtcgtcttgagttgcttcaaca

SEQ ID NO: 2495 - DNA, 861 bp, Riboviria sp.
  isolate bpk205shi02 genomic sequence.1
gtccaaggggtttgaaggctcggtctaccactttgtggggataaattgtaactgcgagcaatggttgttggtttcaccctgaaacccgtggcggctgttaccccatctttgagttggtggtcacgctgcaaacgggctttcggtgaagccgtcctggagtctccaatactccagtctctttgctgctatgacagtagagaggtagagtcgtacaaggcggatcgcgaaatccgccatgacatccgtgaatccatgcgcacacatatgggttatggtacggctgctacttgtgttgagaatgtgatgttggaaacgtttaacaccaccggctatgatcttagcaatttctcgaccatccggacccagtgcgcggggttgcggaaaaccatgacacaatgggacgaattcttccagttgaaaggggttgacccattcaaactggtggacttcgagattctacccacttgtgttgtgcccaagttcgctgcgtcaatggccttgatgctgagaagcaaacttggaaggttagcaccaaatgatgctaacacgctccttgtggagagggagtacttgcgggtggcaaggaagttaaacgtgcgcgatgtggacatcgtcgcgcaccagcagttcgtgatgaatgctgtgttcggtgaaacgttgctggacagtgtagctttaaccaggagtcgcattccaaggtggatgcggtgggcgttcgaggtggaaacaccgacagcgcccgtccgcgtctgctaggggtgcccactcactgtgcgtggctgtgacactaaggttgctgatgagttgttagaacagatcagaacccaatgtctcggcaagttgtgcgcgcgcaggaatggg

SEQ ID NO: 2496 - DNA, 862 bp, Guarapuava tymovirus-like 3
  isolate GTV-like3_1 polyprotein and1
ctcacgcgccgttctacctgactcccacgaagatgagtctaccgacagcacaccccaaagcgacaatctcacaacctgccgctctgaggctagccctacaaccccggtccttgaacccttacccacctccgctcttgcacccgcccaaggcacttccgctgatctctatgaattgcctcctttcgtggctcaggcccccctcggtggcgccgccacctcggccgcccctttttgcacgcccgtcggcccgtcgctctctgaaccggaacgtccgtcagcgtcgagccctctcgacagcgacgtcagcgccgcgcctggcgtctccgagcctttctaccttcttcacaactttcccgccgccagcgacattctctggcccacgcgtcgacgagtcaacggcgcttcgaaccttcccgtcccacacaacaactgcctcctcgttgccctggccgaagttatccctactcagtctgtgcgctcactttggacccgcctatgcgagctcctccctgactcacaactcgacagcgaggagatccgcacaatcggtcttagcaccgaacacctctctgcactcgcctggagccttcaggtccatgtcaccgtcgtctctggcaataccagcacctacggcaatccactcgcctccgctaaagaccattacaccatttattacggcaacaatcacttcagcgcccagagggtgctccgcggcgccactccccaaaaatatcgcccggtccgacattcagactacgcggccttacacaagttcaccaccaacagcgggcatcgcctccccttcgacaaatttcacaagcacaccgccgaccgtcatcgtgccaagaacctaatctccaac

SEQ ID NO: 2497 - DNA, 862 bp, Lactuca sativa picorna-like virus
  strain pt151-pic-8 genomic1
gtaggtcatgtttgttgaattggaggcgaataatttccttgccgtctctaaacgcgctagtcagcgtggctttgcctatgacgaacctcggaagcataaccgagctatcaatattgctgaatagattacgtagatctattttaaagaagaatacggaccccataatacacatagagagatttgatcgtctatatgatttgagatgacttctttattttgtggttttttcgggcttttatttaaaagctccctcgggttggtctcccgagtgctttcgacattagtgtctaatgatataacgtttgagaagatattcagcccatcgtacgtacttttttccttatacggtagccccgtttggaattatttacttactggtggtattctcgcggtaaaatgactttctttttaattttcctttgtaaaatattaaatttttctctacctattttcattctatcatttatgtagttatctttctgtgtttcatatcactcggttttactgttggcaacacattgttttttacattatctcactcggtctacatggtggtacttcataacatttcactcggtctacaaggtggtacttcattttcattttcattggttatttgtccattgttgcgcacttcaacggttgatgtgtaattcgttgttttcccccagcgtgccgtagttcacggtaatatcatgaacatccacgagcgactgagcaggattagctttgacgttgctatcgccgtatattttatataatccgcgtgcggcaaacccataagtggtgcggaaagaacaaaaacatggaccattaaggccgtgagcatctttgtgatactactacaaacaaaaagcagacc

SEQ ID NO: 2498 - DNA, 863 bp, Beihai picorna-like virus 54
  strain BHNXC41489 hypothetical protein1
ggttaacaccgcatagcagtcactttctcaagaaaatcttcttagaagactttcctgacatgaacgatttgttagagatttataagatttatttgtgagtatagtactccttgtagctcggcgaaatcgtagagtgcttaactattgatatagtcaattctccttgcagctctacggatttgtctggagcttgattttgatatcattagacactttaagtatctcctaatagctttttcatgcagaaagttttaaactaaagtaaccaacaccttttgtatactgccatgttggcagctagatgttcctactttgaagtcgttttataccgcttctggtagtgttttatatttgttttaaaatataaaaatcgcttgtgtgattcccagtagggaatttctaaatagtggactccagagatgagtaatggccactttgatgaacctagaataagcagttgacgcgagatagcactttgtgtgaaacggtcctgtgataaaaagagaagccgcctgagtgggctagagcgtttggaagcgttcgtcatcaaagatgaagaccctttatgggtaggatacaccaaatattgcaccaggcaatgtgcaatctgattttactatttgagtcagttaaaaccaaggttgaaggccaccttgaggtctctgcggcagaaatcaccgttcaatgacaaattctctcgtgtaaagtgagagagacaacagcaactattttcatcagttctattacactggtgaatcttacataggataatagagcaacttcccggtagatgtacccggatattaacgagcacgccgtagcgtgcacatcatgaaattttgtctttcccattccattttgga

SEQ ID NO: 2499 - DNA, 863 bp, Beihai picorna-like virus 2
  strain BHNXC40556 hypothetical protein1
gatctccacacggtcctttcgaccgtgtggagattcagttaatttcttttgtcaaatagtttattctcagaagtgcatactatatgcttctgagactttatgtgtagtaagtcatactttagagttgagttattacactctactctactttatgatatatgtatgctatacttaaagtctatcagaattgtacttctgttagtgagatatttgatttataagaattacagtaatcgaaaccccgtcatttatcgactttctgtgtttgaaatgtcgcacagatcgtagttcctaaagttagacataacataatttaaggattgtcaaggctaatgattaagttgttaactttcttcttatgatttagttgtactttttaacttgatatagcgcacagcaccgtgcgcttccaatccgacctcttaggtttaatttgttagttcagtaaccgtcaattattgaatgtttacaaattaacccatttgtttattaacactatttaaacatcttatttataatatttttgatttagacataggacttatataacctgttgtatccccctactatatttcatacttgttttaacggaaaaccgcgtaaagagacgtataggattcccagagaatttgtcttatagtagaagaatcggccaatggagtatatttaacgaaacgtacatcgagatccaatgattgtcggaatatattaccaagatatgtatagtttaaggcatcgtacaccgcgatgttaaggtcgtcttacctgatttttaattacctctacttggaattgacccattaatagagtaaataattagtgtttatatattgtgatttacaataaagtattttgacgttttt

SEQ ID NO: 2500 - DNA, 864 bp, Rhizophagus irregularis mitovirus 1
  RNA-dependent RNA polymerase1
gggtgtagccggtagaaataccggttacatgtcaagttactagagcttggctctaatagacctgatgtaggagtttaactcctgaagggaaagtccgatcttggaatggttggacctaactattagctcacctggaatctagcaggtttgtgttcagaacctacctttggagcagggaaccgtaaatgggttttcacacctatgagcccggttaaagcttaacagggtgcccggccagggcctctgacagggtagataagtaatttggaaacaggttactaagaaaggagagagggtaatccgaactcctgccttatagacagaagcgaccgctcttaaaccggagcgaagtagtagagatgattctctgaaaggacagctggcaaagtcagttgctagattcgtaacgaatctgggagtcaaataggtagggtagcacccatccttactataaggtcccccgaaggggataaactgatcacaaggaccaactcattagttaaaaggagataaggtgcttgggtaaccgagtaccggggtaactgggatctttcgatccaacgattgaaggaaattacgagccttattcctgttagtctgacagggtaaggtgagaccaggtctctggcaaactcatagagttaggaccaaaggtggcgacaccgaactgaaccacagttgcctgcggcctgtccggactagtggattccctaggctcatgctgagcaagaggattcaaaggtccaagtaacgaaatcaggaagagttctgggtagccctgtatagggcatcttgagctttaactgaggacagaaaccgaaggtttcaataatcgacgctaacggtcaattcaatctactaatt

SEQ ID NO: 2501 - DNA, 864 bp, Shahe picorna-like virus 5
  strain SHWC13542 hypothetical protein 11
aatttttctgcacatttattgctagcgccttccctcggcgtaggacggtttgtctatcatctgtctgttcaatgccaaaccatgatgatcacgtattgtcatggtatgtatcagtcttaagactgctttgaggttttcaaatagagggtttgcactagctttgctggtgcttttggggagttatctccccttttagcgttattgcctcatgaaaagggctgtaacgcgtagttttcgctgcttttgactatgataaaagcagcatatttgcctttatggcaaagtcttttgttcttgactttactaagaacaataataggctagtatttgttgtaaatacgtatcgttccacgtattgtagtaaaggaacgcatgttttcaacatgtagggtgcaaatcccttgctggctctttgcgttttgatccactttatgccagtattgcctattgtatttttgagctttggatcagctcagttaagttttaaaaagaaataaaaattaaaaaatatctgtccaaataaaaagattatttttgtcatatttgttttaaaagctggacagcaaacagccattttaattaggtggagaaatagattttctctggttgttattatacgttttatgttcttaactgtcactgcatggaatatttccggttcacacaggttaaggacatagccaccctgtgagtttccggggcatgtttcaggccttgtaacgtattttgcatgcttcatttgattttaatggtttattcctggtaggtaagagtccaatcaggtcttccccgtgggatcacggggtatccctttgaccgggagaaataatacgtcatttacacgcctagagacacgaaacatta

SEQ ID NO: 2502 - DNA, 865 bp, Fusarium graminearum dsRNA mycovirus-3
  complete genome.1
gaataatagacccgaggagggtggcctgattcgagccaggtagcccctccgtctgttatgtgatgtcctaaattgttgggcctcacctcaaggtgcagagacgattgcactggctgaacctcggccgtaaaacgaaacccggtgctaaatcacaaccacttcattctttcattggttgagcgggtggatacccaacacttacagatgttgggacggttcagcgcgcgtaagtccgttagggtagggtggctttatagcatttagccacaccaggccagcggcgcgtagcctaacatttagaaaattcgttcttccattaataacggtatgctccgttagggagaacgatgcttttaaatcgagcgtgcagcaactccgacctgggcatgtcgttaaactacctaccttatcttcgggtgaagctggtccccggagatccgacaaagccagtgcagcctcctgtgattaaaccagcgagtagggaaccgacgccgacttccagatatggtcgtccgccgagggtgtgccaaccgatcagcgcttgcgctgccagtgtaaaaactgcgctcttgagattagagggttggtgctaacgtagagatggtgtccccgcgggcttgttcctcgtagatatgcgagggagcggcttttgcccccgatccgcgggcatatactaccactcgaacgtgctagacttaaaaactctagtggagagacaacacctaccgccccgacctgcgcaatgtcttcgactgttcaggaattacgccatggcgcccccaagtagcaatgcttgggccggtgtggttgtatagggcacagaaagagtccgctctcccttcatatcccctgaagggcgggaacg

SEQ ID NO: 2503 - DNA, 866 bp, Wenling crustacean virus 8
  strain WLJQ104142 putative glycoprotein1
ccacattaacttccgccccacgcacgccgcatgtggtataatattactccttactttatagttttcatttacacagtatactgcttcttgtttatcctccatatggtgttaaatatattagtagctcctataattgtactaatccttctcataataatcttgataattgttgcaggctgcttttccacagacttgagtgctaggtgttcgcctgagttgcctttatccaaatgctcaacacaacaacagtcagctggccttatcctcaatccataggatttgtgttgtatatatacgccttgtcgatacttatttcactatttgtatatgagcttttaaccctgctgcaaacaaagtccttcttgaggtttactatttacttgtctttcatactagggctggcttattacacacatcattatatggtacataatataaacaccattgatagttacaatcaaatgactaatgagtgatatagtagcatctatttccaatctacagagtgatagtctaaacttcaggtatagattcattatactcacaaccgtatcgctaagcagcatattaatcaacctactatctttgataggtttattaatttgtgagaagcattgttacttacctgtcactaactacaattgtgaagacatagactatatatattatgagtatatattctctcattacccttttataggattttacaacactttcagtagagaaggctgtgatttttatgttactttctataataaaatctgtgttagttgtgattcatcatcccgttgctataagctacaaggtgaaataacaaaaataggaaattgttttgctctagtgaaaagagactttagtgcttcagt

SEQ ID NO: 2504 - DNA, 867 bp, Beihai sea slater virus 2
  strain BHHZL10411 hypothetical protein 11
tgcgtagcgttacacgctacgcacgcttattttatatctcgtttatttgatttatatatatttatttagggataaatatgaagatttctttgagaaggtaggccttggcttagatttcaatatttcaatattcgagatccccttttacacccccctcttttctttttaattggctggtgttcaaaattatttattaattttattttattattcgtattagtatgtttggaaatctttaactattacgaatttcattaagttggagtttcaaaattttcatctcgttccctagattatgtatgggaaaaagttcgtaccctaacgatttattcaatgggtaagtttgattggtataaacacgttttcaattttataactaaatatacttgttaataatctcttttattagagttatcctgcgggatgtcttagacataaaattattaataaaggtatttattataaaattagatttctatccggtttttacttagatcatgggaaatctacagtttctataaagtatgtagtcctgttaattagagggcctcaaatattaggtacgcttgatatttgcctctaatgaggaggggaaaaactaaaggtgcgattcgacatcaaacctactcctgtattcatattcgtacgcgtaagtgcttgggatggataattgaatactgtcttatgtaatgtctggatgtaaaagatatgagcaaagtagcaacgtcttgttaaataactcctcttatcggcgcgtttagtcctagtcgcgcagggacacattcttatgttatgtttgtataagatcattatcagccaccgtgcatatcccctcagaaatagcccgtaaagtacgatttatataca

SEQ ID NO: 2505 - DNA, 867 bp, Shahe picorna-like virus 9
  strain SHWC0209c12638 hypothetical1
attttatcatatttagttttgctccggagaaaaccgggtaacaaatggacgacctttaattgtgagacacatgggggttggagccaacatgatattagagatcatgttcggtagatcatcttcggtctggcggtcatagacttccagggcttgatgtcgtccatggcgtgaataccagttaggtctaaaggcgtttgaacaaacaaacagaaaaatgatggtaaaccatcaccacctttacttcgttgtttcatcattgagacaggcgtgaaagaatgccatccgtggagtcgctttatacatactgcgctattctgaccaatattcgacatactagaaagagaatattgcttattgtagaccagccatatgagtgtaatcttggtgcagtccttgttacactatgatttcaactgccacgtaagtgatcgcgtcactatagaattccaaaaacattgttttgttctaccgtgtcaatttatcatcaggatacaatttttgcttaggcattcgatggttgtcgtcccttccatcgaacccgcacctcggagaaaggtgtgctcccacattacgtcaagttaaggtaaagctgctgttataacataatgagaatcaggagatcatttcctatggattagatattacgatttctgtagtatcctcatcatctgtatggatttgtaccaaatgtagttgtgtttattaagtggagcccgatacacttgggtcgtgtgatgagtaaacaagaaggtttggtcaccatttcttgttgggattatcgaggtccgagattttgcgacatttgaacaaatagtttgagagaattcccacttccatttattctagtgaattatagtgctttgcatt

SEQ ID NO: 2506 - DNA, 872 bp, Posavirus 1
  isolate Ishi-Im2/JPN/2016, complete genome.1
agaatttccaattctcatatcgtagactggctgaaaagttggtcttgacgtcgtgaaaatggcgttatattttgagtgtaagggtttcctgaaaaggtaattcttatattgctgtgaaaacggctttctctttttatctcctcaaactccttattttgcattctggctgttcaagcggcccaaatcgcaagcgtattacatttccttgcgtgcgtacccgaaaatttattgaatttggcttgaattataagcaatgcttcttatagcggacactttgagaatataatgcttgcatggattaatgtatactgtttcaaataacaaacctagacacgcagttgcgttgatggttgtatcaatcacatacgggtgttgaactcgtgttaatcctcgatcgctatatgtttgcctcctacttccaataaaatagattacatacgcgacatgcctttgtggtttacctattggcctctgtcaaaaacaaatcgttcgatttgtagtttcctggcctaaaaagctgggcgcggtctggctctcgtcggatggaaaggtccatcaatggctggttgagtgtaagctccggtgttctggttgtcgcaattccagacgtcgtaataacctatattgcatctgactctaattcttgtggctctactgtatctagttcttgttctactaactctaacaatgctactggttctatgtttgaaaaactctcctatgtcaatatagataatgtccttgatcccgatatccctcacatcactgaagttcatcgcaagcggatttcagatgatatcctcgaatctcaaggctgtacttgctctgaacctattctcactcctcgtgtgtttactttttcaactcttggc

SEQ ID NO: 2507 - DNA, 872 bp, Hubei picorna-like virus 37
  strain QTM27228 hypothetical protein1
ctaggaggcactcttttaaacactgtagatcggtcgggtaacagcgcagcgatacaagattcttccacagcccttcaggctgactggaagtttttcaaaatttcaaaaccccaacacttttaaatgtgatcactgctttccactataagactgcttgaacaacagtacgtggttagttagatttagttttaagtaaagaagagtaaaacatcaaagctctgacacggatgccgagcctgtgagtaagccagacaagcagcattaggcagaagtggtaaacgttcaccttgagaaacgtggacggcgcgtcaacgaagtttactttataagccatttgcaatcgcgtcgtgtgggaaattggaatgttttcttttatctaaagttcttgagtataaacaacccgaaaaggccgtagaaaccatgaagattacggacgagggggcgacaggctagttataactaagttatagcgaaatattagtgcccagttgtttaatatgaaagaatcgcggatttaagagaaagtaccatcgtacctgcgtaaatcgtataagaagattgaaatgagtttaagcaccaagcatacctagcgggttgcgactaggcaagtctaacttgacgggaaatttaaagcctcccatggtgtaagtaaatagcgaaagcgagggtctgacagtgtgcaagctcagatgctaacccttagttgttcttatttagcaaataagattaccctaaccaggtaacgacgtcgaaagccaatcaacataggtaaaatcttttaggccgttcatcaaaattaccctggcaggactttcaaaaagaacgttctgctttcaaataattgcacaacaataaaacaagtgaataataaa

SEQ ID NO: 2508 - DNA, 875 bp, Guangxi changeable lizard picornavirus 1
  strain GXSXC1289721
tctagccgcggtatggcaaccgcggcgcccaggccccgcctgttgttggtccttttcttaacccacttttgtggctattgcctgtctctgcttgcatacaggcatgtgtcctttagtgagttgtcttggactgtatacatgggcctcggtctttgccacctctcccatttttcaccacttttgtaactaagccttctttctcgccacaatataacttgtcacactagagagtattttctacttggcggctctctagggcttctttatgaacacagtgttgatcactgggagtccaccggctacgctaagtttccctttcccccactgcctcacggcagttgggttcttaccctcccaccccctcccactttctctaatctttgtcttctttcgtcttgtttttctgggttgtccccgtaaccaagtcgatcaggccgccagggtctgaatactagtagcaggattagcctcttctagggtagacgaaacacgagggataggaagaagtagatttttgagtttagtttaaggtgcccttaactgggtaactgtcttcaggtctttgtattcgatcgcgcggacaagagtaggctacgggtgaactcttgtttttgttggagaaatcctcataatgtagtgcgacctgcaagtgcattgattggccgtttggtgcattaagttgtgccttacggacatcctctaacgcttggggtacaggagtgctacaccgctcgcgagtacactgctctggaggcgggcctttcattaggctcacctctctcttctttctagcctgcaaggtgacgggctcttgccccgatccctgtcggccgcttcctgcctggcttttaggttttacccactttatagcattg

SEQ ID NO: 2509 - DNA, 877 bp, Rhizophagus diaphanum mitovirus 1
  RNA-dependent RNA polymerase1
cccaggttgtgaaacctggtaacatgtcaagtgactggagcttggctcgcagtgtagcttgactgaagggcttagaagcccggaagttaagtttgactctctcttctaacgaggatgagttctacacctgttaacccatctgaaatccagcaggtactgtttctatacagtcttcgtaacagggttgaaggagacacgcccgcggacgtgaatcttcttgaaaagtgaacttgggctggggccaccacctaaggcgaagacccatgaaggcaacaatgccaaaaaacataaagagattttctgtaaaagggatttctcgccatatgagacagaagcgaccgggttccctgcccgaagtagtaggaagtgtcagcgcaaacgcgagctagtttatactagtccgttcggccgaaagggccgttgggcactacaggttggttagtaccatccttacttatatggtcccgagagggataagtagaaacaggagaccaccctatagtgttggaccttagaatcgagcagttgtaaaactgtttgaggggcaaaaggattatggatctaggtgtcttacctagtttgtagtctatctaagctaaaactacttaggaaatggtcaaaggaggcgactccgatctgtaccacagaaacctgcagcctgaccgaagaaccgggatatccttaacaggaccccttgttcgccagaacccctaacggggaaggtaagcctttaaaggtaggtgagacctcctggtgatctattcaagtaaataaactccgaaggcccgttggtagccgaatggcatcatgggagataaagagggtcagaaactgaaggctatctattaactaacaatggaacaactaactctacatt

SEQ ID NO: 2510 - DNA, 877 bp, Picornavirales sp.
  isolate H2_Rhizo_Litter_7_scaffold_242
gcatgtcattttagtcgcgcgagggggacgacgttaactacccccgccggaatactaatccttagacgttcttccctttggattaagtaaatcttaattacttttaaatggctaatagcgatttaccggaatttttacaaaaatacgtcacaaattttcccaaggccagttctggattgaacaatcaacaaaagcaaagtattgaagaattgagaaaacttcccattcaggatacagactcacctcgtttaatttgcttgaagtgttttcctgacatctctttcgagtctatgctaaaagaagaggtgtttaagtgttgttggtattcatatttagaacatagcagtcagtggaaaaatcatgtccgtgaacgatacgaacgtagtcgacgaattcgtgaagaagagtctgcctctgggtctcctgaggccgattaattttgggacgaaggacattatctgctattatttcttgtgtgaatatacgcgggaagaaaatccatgcccgcttaataatcaacttgtagcaaccaattctcttcaagaaaaattgtgtccattttgtcaaagtaaacgtaggtgtgtcaaagcagaataccatattaataataaattggctgatgtacttccaaattcaatcatttttacagaaatcgaagaccacactaagtcgttgagaacattgtactttaaaggattttatccaggagacgcaactctcacaggcaagaaccatttcaacattcgagccgggtacaattatcctgacggtcgctgtgtggaatttcatcaacgatatggacctcctcaaaacaattatctccgaactcaattcagctttggccactccccctgccccccaatcagaggaaatggag

SEQ ID NO: 2511 - DNA, 877 bp, Aedes albopictus negev-like virus
  isolate Aa23, complete genome.1
cagactcccgaaccatataccaaattgctagatttagtatttaccaagtaccagaacgtcacactacaaattctgcaagatcccgttattcaaaacctcacatcttacctcacaaagaatctcacattgaattttacagcagaccctatagattacaacgctttgtccgcactactgaaccgcacccttgaagctttggtagtgaggttacccaacatgtcacagaccaccgattacaaaaattttgccaaagttatacatcaatccccatcaaacaccttatcattttggaaagaaatcatagactattttattgagcacgattacagtataactcacaaagtttacggacaacctgggacgaaaaagcggttctctgttgtaggctatttggaaagtgttttattgaaagttgcccatcggatcataggtacgttaaaggccgtgttgcacgatatcatagaacctatatttttaaaaattttacgcaccatagtatctcttaccgccgaaattgttaccgccgtatttcacgtaattaaggcattatggactgaaataaagacggccgtcatcgataatcctgagttagttcgtcatttttcaacttttgttaagtgggtcgttcagcttgttcgcgacgtttcccacgttctcgtggagcatctcgtcgagttgaatgaacagtataaggttgtggaattggtattgctatttgtcgtgtgtgttaggtatttgcgcggttacgtcatatctgcgtttatagtggccgccgcaggataccattttggatacgaacgtgtcacggaacataccataatagttatattaattgttattttttcatttatacacttcctatttccagatttaaaca

SEQ ID NO: 2512 - DNA, 877 bp, Beihai picorna-like virus 20
  strain BHJJX25607 hypothetical protein1
cccgtatgcacatttacatgtgcatacggggattattattgaagtgctggggattctcccagcaagatttttacacgagtacgctcggtatttatcttttgaatgacataagtacgcttttgttattcattcaaaatattattttccgaaatttctttatgtacgtttgtgggtatctaataaccctctttcatgaacagaaataaaaagtttagacctaggtatagcagaggagtctttaaaaggccttactggtcctgatcatgaccacttaaactgattattctaaacagaattcaaacttatacactgtcgggtgtttaaatacgatgtgatgaaaacacttataaaacatagtgtcaactgatacacttgtacacttatatacaagagatctaagctgtaattaacagcagctgctttgttaagtttacttctttgcagtgttttaacacggaattcacatattcctgcatctaaatgcaaatgtgatctttgcctatgatatgtgcatagctgcaccgagttaacgctgaacgtctctcacaatcgtgagaactagtatgtagggaacgcaaaacaaacgaggctcagtagcaagcgttttgaatttattaaggtaggcttgctcatttatataaatgagtttcatatctggaagtaatgaccccagtatgatgagaggccttagtagataagataagctaacttgtgagttgaggatggccatttgtccgtggaataacatccaatgatgctcctgacgaacgttctttagcctaaccagctatcgaacccaaaggtgctgtgccgactgtcaaagattttatctttacaggacacctgtacagatatctttgacacgttgcatttaaca

SEQ ID NO: 2513 - DNA, 877 bp, Hubei picorna-like virus 38
  strain spider133826 hypothetical1
gttagtagcccttcttttataaccccgtaacaaaaggttaaacccttgggaggacctgaagcacctaaaagcgcaagatggaaaagctactaaaacaaataattaagaaacagatgttataaaacatcacaccagcaataaaacattaacgttaactggttataagaactccttgagaaagagtatcccagttatattcaaaattttaaaagaggttacttaccaacttaaccgatatttcaaacgagcgcccgagttagccagacaaggaccagtagggagaaatagtaaatgttcaccttgagcaacacggaaggtgcgtgaatgaaggatttaatacaaccgtaaataatcgcgtcaagtgggaatctttacagagtgtagataagagaaaatttttataaactagagtccgaaaaacgactgttccgaacaaagtgttcacgaatacagttgtggggcgccaagcgagacaaattaaattttgtttgaccagttagtcccagctcttttaactattaaaattggaaactatctatcataaagtagagttagtacctttgtaaatcgtataagaagaatagttataggttaacttatttaggcttatttgacggatagcaatcaaactactagtattagtagacgggaaatttgaagcctcccaataaataagttaaatctagcataagcgtgaggccggcagcgtgtgagaccggataacacctcatagttcgcgacattgaatgtagagcaacataggtattttgtttcgaaactcgttcaaaattactctggtaggaattcaaaaattgaacatcctatcaccaaataatcacacaataataaaacaaacttaaataatcatatatcaata

SEQ ID NO: 2514 - DNA, 878 bp, Botrytis cinerea RNA virus 1
  strain BerBc-1, complete genome.1
tgaataaaaggccgaaaggctggattttcagagcatcgctccgaagtccagctaccttttatattgtccacttaattagctagtggatgatctcaggtcgggagacaatccggccagtgtagtagggggcaggaaagaactaagcacgtgcttatcggttgagctcacccaacttgggctaaactgtagcgtgtggatactcaaggtgtcaaggtgcggtcaacatgcaaacacgaccagttccgaaaacatccacaaaccttgaggcctactacagagcgtaagaatgctagggtagaaagagctggggctataacccccggatctcttatcaggccagcatcgctcagcccctctttttgtgtaaatcccacccggtctagcggagtgggacgcatataaaatgagcgtgtgaaatcgctctaaccgtccaagcacatgacactaaactgtactcgcccaggatatggcgttaaactgtaccatccgcttttgccagcggttaaaacaatggcttttcataacagccgcgtgtgagtccgcgggataataagtgttctaacagactcaaaaagacatcctatttccaagttttcgtcgctacgtcaaacgtcggcacttcttggatctggtggggtaacatacacgtcaagtatggtgtgaaccggggctacacaactaccggggagctaacgtaactgcgctggtgctctactttcaacgtgcttcaggaccgaaaccgtccgtaaaccaatgggttgcacagaaagtaaaggcgtagggaacgtgcctgggacaagaaccaggtggacagactgacactcaccagtgccttcccgatcgaaggcagtagcaaacagtcggtgcgggaactccgc

SEQ ID NO: 2515 - DNA, 879 bp, Frankliniella occidentalis associated iflavirus 1
  isolate1
cagggattttatccctggggctctttgagaagattcactaacactgcgttgtaagataaggaatactgtcattactcactcacctcctagatcattcgaaagaggtagtatgatttcagatatttaaactcgttacggcactgtggtagcttgcttttcaaactcgaatcaccattcgtttcacaaaattcgatttagtagtatgtctcattgactttacaagtaatcatataatacttgttgttttccatttgaggttttctacctcctaaatttaatcaaaattatgggttttcttcccgtgaaattcttttagtttttaggcgcttttcgaactttgtgcgaaacaaagcggaccgtgatatatagtggaagttcaatgtgaggtaacggaaagataaccgctgtgtaaaataggacttattctatgtgtgctctttgagaaattctttacctagtattttgaatgagatacgatggggaccacatagttttatcctagcttctaatatactctcgtatctgtttggagcgattgagaatagtagaagccataagttacttctgtgcacttgctagtaaaacggaaactagtcacctcttagcagtgagatactgttaccgggttggcatccggtatactgacattgatggaggttacctgatactggcgcagagctggtatggtgcattggatgagtgcttgcattcgccagtggattggtgtcggctgcacgcttataacgatgaactcgaagatgggatacctgtttaggtccttagtgagaagttatttgcctgtagacctcccttgtaatcgatgaaatctccggtgcataaaacgggctcagtgaagaacacagctactttgatttcaat

SEQ ID NO: 2516 - DNA, 881 bp, Ryegrass mottle virus
  genes for P1, protease and RNA-dependent RNA1
gttgatacaactaggtctttgcgacccagtgcgtctcttcataaaacaggagccccatccactcaggaaagttcggactggcaggttgaggctgatttcatcggtatccctgttggaccaactggttgagagggttcttttcggttttcagaataacctcgagataagccgatggaagcagtgtccatcgaaacccggaatgggtctcacttctaaggagcaatccgatgcgttgtgggacgagctgaagttcaagtccaccctagcccccgcggctgaggcggacatatcgggattcgattggtcagtgcaacattgggagctaatggcggatgtcgaaatgagaattcgactcggagacttcagcaaccttgctgcaagggctgctaggaacaggtttacttgtttgtcgaactcggttttccaactgagtgatggcaccctgatttctcagggactaccaggcctaatgaagtccgggtcttattgcacttcgagctcaaattcacggataagatgcctaatggcgaagatcatcggctcacgatggtgtatagccatgggtgatgattccgtggagggttgggttgacaatgctgtagaaaagtatcatgcacttggtcatgagtgtaaagaatactcagcatgcgcccggacatacgtgagcgggagcggagaacaaacccttcaaacggttaatttctgctcgcacgagttgtccgagggtaagtgtcatcttacgacctggagcaaaacgcttttccgattcttccatagtacggctccgtgcattaggagtctggaaatggaattagcgggcagcccccagtggcccaaaatctatcggtacctgcgtcgggtgggcttagcgcccgacaaag

SEQ ID NO: 2517 - DNA, 882 bp, Marburg marburgvirus
  isolate Marburg4
cattaagtgtgcaatgatgagaactttaagataattgctactgagcccttcttctgatctactgaaatcaacttgggagatttttgagaagctgataacttaatgtgaatcaacagtttacgtattatcgattattatggtttgagattcaactgttatcatcgtcaagagtgacctttcctatttgatgcattaatgttttaaactacctcttaagcctttgtggatggtctcaatatgcgcgtaagggttaatttaaagagatttcttgttgcatagtttttcgtgttactgatttaggcttgaagacatagttaagactggccgaaaatgctctccagtcaactccatttcctctcaggggagacgtgctgtccaaagagtcttaatccataatcaaccattgcaagaattaatttactttttccgttatacttatctacattaattctttaaatgtccagcattattaacaacttgccttacttcaatcttttggatgcaaatcataaggaaagatgagccactttccctctaccctaagctaaggaaatttctcttatcagctcaaaatatgatccgtcaggtcacgggccattcataatctgtttgagcgtgaatattgatcaaataaccaaatgatgttgcatttgtatagacgcaattatcctttattaagaaaaagacaaatagaacacagatagttgacaaaattttactttgataaattttgcgaggaattataaaaatcttgaaggataatttatagtagagtagaatcgaagaacattaagtgttctttgttagaattattcatccaagttgtttttgagtatattcgcttcaatacaactcctctttatatttgatttaagatttaaa

SEQ ID NO: 2518 - DNA, 882 bp, Barns Ness breadcrumb sponge weivirus-like virus 6
  isolate Z53,1
gcgccgtaagcgcgaaggaggacacaggtacccgatgctgtactgattaattcaggcattttgcctggtaaagtcccagggccatgggaggaaatgcccatggcgagagagggaagacgacattgcaaaaccagggtttgcccccctctgccggagtcgtccgggtgttggtagagtccacccgtagaccgaggcttattcttctacactcactgtgcccgtagtgagtggcgagcctgctgacgctgttttttccggagcgtctgaggtgaaggccgtgcgagagggggatttagtcacctccttggtttggccaccttaactcgtactgaacggggcccaggctctttggcacgccttttgcgtggcaacactggctaccaaccggcgacgggtggatagttggaagccccgaatggaatggctatgatgcgacctggcgcgacggtggggagtctcgttctgttacctggtttcgccaggagattgactccgtcacaccacatcaatccagggccatgctgttgacaccgtcagcacatccccagtgaacctctcatgttgagtcagggccgacgcattttgctaggccaggcagggtcgagccccttaaatagccagcagcgagcacgttgcctgatgcagagtgattcctattcatattatgttcactgcctcccattgcttgagggggagggttaagggggaggttgatcacctccgggactagtctgaccggttaggcatggttgactgtgggtaaccaatcccacttagggcgttttgcaacacttgagcccgtttggctcatgtgacctggtatcaccaccggttacgttactttaatcacggcgctgtctgccgtcattgcctttattaaag

SEQ ID NO: 2519 - DNA, 885 bp, Hubei toti-like virus 10
  strain 3mos6210 hypothetical protein 1 and1
cccaaaagggtctggtctatgtggcacccgattctcggtgcgggtccttgtttgcggatgccttgggccggccggggatcgttgcgacgggcaggtgctagccctagcgtagcctccttctacagttctcctggctgtgggaggaggtcggactgatgtcagctgcttgggtaaccaagcagcgtaacccgagcactctccttcgggagggtgtaaggtgtgcgcacactcttacacaactccttggtagaaacggcatataaaaaccgtggttatagcaaccatgggagactttttacccggccctttctagggcctatagtgatgccgatgtgaggaggtggagtgaacaggagataacaacatgcaactacaatctgagaatgcatttcaaaaatgacaccctcttgtagatgcccgtgtagggccagccaaaacgtcatctaagggcggggagctcgcagcgccccgctgatggatagggcgtgctaagtgtggggtttatttaatcctgctaaatgccgagagactgcaacggctgccaaaggctacaggggcacagtcccgtcgtacaggtgcgggcgggtgtttatacctgtagtgagtctgcgattttgacgagtgatattaacaagcgatattccaagttccaggtccctgagcaccttattcgagctatcttatatttcatacaaccattgtgtgaggcgttcttctaagcgttccgtcgcgtccttttcaggacgttagatttcgagtgtctttgaagtgaattaaacagttcttttcagaactacccaatcgcccttttcagggcggcaaggtttcggtgttttcaagtgttttcagttaggccatccaatttcaaacgcttctacttgttta

SEQ ID NO: 2520 - DNA, 887 bp, Beihai weivirus-like virus 19
  strain BHZY59816 RNA-dependent RNA1
gccgtagtgccaggttaacgtattaattaatgtgcgggacacgtatgagccgggcccgtttgggtcacgcggcacttgccgcattaatacctgttggttgacacagagccggcagggtccacgcgtctcgacgtttgcttcggcgggcaggcgtcgcaacacagagtgccgctggcgcgtggatgtgagaccgttccttgtttattgctttacttggataggggtggcggcgcggatgcgccggcccgagtcataccccgaaggttgcctcatgcctgagtagcggagggtagttccgtgaacagcctggaagccgggtagcgccggtgacggtgagggcgccgctgttaaccctgtgcgtgggttggtccctttggagggggaacgtaaaatggcggttccgttgtgtgagtggtgactcgaaggattcgagcctgcgaggccggcaatgctgcgcttgctacgcagcaaccgtgaatatgtgggttttcggtctggatgtttcgttcgcgtagcgcgcgcgggtgaataatcgcctagggaggggcgacacacacggacaaaatggaagtgcgggggtaacggcccgcttaacgcactgcatgggggacgcccccccctttcgcgtgtttcccgcacgccgtaggatattgcatgatagtctgctgggagtagcaaacccgttacagacccgtagtcggctgcggcgccgacgaatttaaagtattgtaggccatatttcaaaactgcgtcgagaacactaccgggcgggccggtggtttcctctaaggtgcatctgtgtcgcactcggcgccacgcctttttctccggctgccggtgggggcagcttgcgtttttcgtcttcgcaatcgggagtgtttttagcg

SEQ ID NO: 2521 - DNA, 890 bp, Pink bollworm virus 4
  polyprotein gene, complete cds.1R
cacgggttaatcccgtgcagcgctctagtagtatttcaaattttgaatcgttacagtgcatttttgttgactaattttgttatctagttcattgtcagttcgatttatcgttcgtgactataatgttcgtagaattttcacctttagtcttcgttaaatgtattgtttgttacaaaattctttgactactaaactttaggttagttatatattatagttaagataatttatatatatattataacgaaatatagtattaataaaatataaaatacaaggtaccgaccttggctatctctaacaactattaatgtaagtgttatgtattttcactgtcggccagtccaagctcttcatgggcgagacaaacagtgacaggagcacaatcatccctcctggcaacaagtacctctcacacttttattaatagaatgattgatagtgtataaataataattttaaggcaaggttagattgtattgtaaatgtctacgagtagatgaaacggtctttgataagtgtgttaaaatggggacccctccaactggtttgcagccagcgcctactgccaatagacataaaacgacataatcgaaagtgaccgctttatgtgcaatgctaacgaccactcttctgtaatggagggagtgtaattcggctgggcaagtcccaaaacctcgatgacgtgtttatccacggacttcgggaatatatctctaagatatagtcgaacttctgaaacttaaatttacggacgttttagtaggaagattaaaacgtgtccatttctttcatttcttttcttatggtgacaatttgagtgattatttcagagaatttgcgcaaatttataaaagttatttcccatacacatttttattcctatcacc

SEQ ID NO: 2522 - DNA, 891 bp, Rhizophagus diaphanum mitovirus 3
  RNA-dependent RNA polymerase1
ccggccttcctttctgtccctagccaggcagataaactctcattcctatctaaatcctaactccggtgaggtctctgttaacgctgagaaccggcaaaacgcactcaatcaatgagttggccacttgtgatgatgcgtataacccttcctactcttggctagaggaaagaagggtttcctatacatgctccctcttttcctttccaaagtatgttactgtccctaatcttaaacggctgagtagattgtctctctagtatcagcaatgcttgaccatcctagctctcccgaagattgatcgcttctgggtcttggggtgtccgagataggaacggacataaatatatcattaattacattcatgaagtaagactcctcttaactccctactctactctagtcctaacactgttgaggctaaggtaagactgcggtcttcttagatcaactacttgtccctaattgcttccacttcataacaagtctcggctatcacgagcctcggctccggtagagttacttgagtcccttaagtcccaacgtccctgtccttaatacatctctctgttccctttctctctttcaaaactcccctctgactccttgaaagcgtagattcaggtcttggtaagcgtggcaaggttaataactcacaaagacttgtaaaccgcaaatccttattagtagaacataaatgattgttgaagataagaaggtctacccctcatcacttgtagggtcaacatgagtgtgcccgtcttgggtatgttactaattcggtacctatacggggggagattaaagcccgcacgtaccatccctaatcgaagatatctgtgtgatcagattttaatggacttactatgataagtagtacagcagttttcagta

SEQ ID NO: 2523 - DNA, 897 bp, Hubei odonate virus 5
  strain HBOV5 205551 hypothetical protein1
gtgtttaaatttaggttaataccttcttttaaacactgtatacacacctaaaagcgtaaggtacaagaatcatacaccacctaaaagcggactgtatgtttaaaacaaaccccaaaatccaattaaaacaaaagcctagtcagttaatattaatctgatttaattcaagagatgtgggaagtctcgataatattaaccttttagttttaagttcaaagaagagtaaaacaactaagctctgacctcttagccgagccgtgaaccgccaaagaaaacgcagtaggcgacgagggtaaacgttcaccttgagaaacgatgaaggtgcgtaatcgaaaacttaattaataaattcatctcttgacaccaagttgagtgggaaaatttattagtttgaaactcagattgtaataaaattttgaaccgaaacgataagatttctatgaatgaataccttatcaagggtgcgccaagctagttagattaaattcgaaacgaaatactagtgcccattcaaaactataaaaacaattgaaactttaaactaataaaaatgtaccttcgtaaaccttgctcttttgagagatggatattataacacataattgcttgctagcgggtagtaactagccaatttattgaaggatgaaagccacatcccattatgtgattaagttagccttttggcgtagtgcaggaaccgtgtaagccctgataaaccactatagattatgacattgaattcagatcaacaaaggtatgcactttcggaaacccattctaaattactttggcaggacttcaaaattgaacgttctgctttcaaataattacacacaaaacaaaactttatttttcatttcaacttcgtttaatttgactttgaattaataatcaatt

SEQ ID NO: 2524 - DNA, 898 bp, Lentinula edodes mycovirus
  HKB gene for hypothetical protein,1
ttgcatgcctgcaggtcgctagaaaagacatggttctaagtatagtcgacaacggtctattgaagatctcttgcagatggaagatgccgttgatacatagccaaccttagtcgttagggtaactatgtatggagagagtttagtcagtctgatctgaagaactactctctgtcgaacgataacagccatttcattttcattttctttcttttcatttttgttccattaaattcttatttatttcacgttctgcgggataagaggccactaccgcgatagaaattagtgtggaattaagcatccaatcaagaagcagaagtccaacagccagttggatactgtaagctggaacgggattcatgtccgtgcaaggacctaccccctctacctttctggagctccgtgcctacaaacttacctgacctagttatgcctagggtggtatgctgcgtaggagcgaggagactggggagatgcgggacattaagagtaggcaccgagtgtaacgactgcgaagctttgttcttggttagggaacagtctctccggcatacccgggggtgatagcatgcttgtgggtcttaattggctcgctgcttgtaggttaagtaaccttcttttcctccttttccactacactagtagtgacgataaaggttgctccttcctttcacttcagttattcttccgccgtcagcgaggaaacagttggttgcaataatcttggacttaagtgtttgagatctattgactgctgcgtacaacgttgaggtatcgtttgattgatttggattcttcccgcgctaaacggttaattttagtatcttgaagtggtagccccacaaattttcaaactagcgtgatttgagacgccctgagtggttaatcgcgtttaaaa

SEQ ID NO: 2525 - DNA, 900 bp, Barns Ness breadcrumb sponge weivirus-like virus 9
  isolate Q25,1
tttcaccggcccttggttagggccgggacccttggttagggtcgttaatgttgtgttttgggattcgatgagagcaccattttggtattttgacaccgggcggtacctttgcgcgtggggcccgggtgcgaccagacacactcacgttgttgctcgtcaacgtgaggcaagatggagtgcggacgtctggcgcatgtgaaagatccgctcccctgcttggggagttgcgcggggccatatgccttaccccgcggccgacgataatgtctagctggtccgtcggcgtgaacccttatgcctcagtagctgcggtgctgcgcggtgaagagcctgggagacttggcacgtcttacggtgagggcggcgacttgccttcttggttgggttgggagttggagagctcccgtgaaagtcgtctggtgtggcggtaggccggcgaagcttgcgaagtatttttacagcaagtggattggcgtctgagtatcccgctcgggtgtctaatggttacgcatgtgaatacgttttgcatgcagaatacctccgtcatggcgttgtccgctttgtgagggcacgacctggtcgccgtctgtttggcttggcagagcgcgcgacttaccacaaaatgtctacggtttataaaacctcgtatgtggctacacccacttattaccgaatcctgagcactctttccacacgtgatcttttacttgcggcagtattagatcctttttcatattatgcccacacgtccatccttcgacgtgccgcactgatttgggcttgttttgatagtagcagccagcatggcttaaggtgcaacgcgcagttcactgctactctacgatatcgctgtcgcggttctggcgtccgtgactcagaaaacaatcatcgtcattcagt

SEQ ID NO: 2526 - DNA, 901 bp, Duck calicivirus
  isolate MW20 genomic sequence.1
cgatatggcatacgtaaattctttactcttatttttcctatccctccacaagatggctcacgagcttatcgtgtggagtctctttggggtacgggcgcgggttagccgcgccccaactcccctctttatttcagttaggtcccccacttcccggtggcctggctgtgccacctatacacctggcaccacttttgtggtctcgctgggtgaaggccccattggccgtctggtcacagcacggcccaacctagtacccacgaacgcacccaactgagcgtcgcggcgtcatgaggcgggcggagcacccccctggtaacagggtcctcccgggccacaagccacgtgggcagggcgaaggtgaaggaagggtcccccgacccaacctcaagcctgaacccgcgttcaccctcatgatcaggcaaacccagcctggcggttgtttgttagtattggcgaaaagctggcaccgactgttcccaagaccacccaatggcaagggggctggtgagtagatgccctgcaggtaccctttcggatctgagcaggggcccttgactataccgttccggtaaacagggggtaagaaccatgaaagcgcagcccccacaacgggttcgtccaagggaggggtacccaccccgacctcacgacacccgtcatttcctttttctttttcctcttgtttatggtgacaccaatggtttttgagtctctggcgacttttgtttgtgtttggctcatcttctttttccactcaattcgcctgggcgcacaactcacaaccatttttggctttttgattcgctatttgattggcgtttttctttggctttgtttggagtgcgtggactttagaccctggtttctttatactgactctgcatggtccagatagaatatc

SEQ ID NO: 2527 - DNA, 903 bp, Beihai mollusks virus 1
  strain BHHK131425 hypothetical protein 11
ggactctatataggtttcacaacctatatagagttccatttgattagatattgtccgcttagcaccggaccatgcttttcttaattttattgaatacttacattctgaataagtatagtagtctcctctcaggttattactataccctgtttggagtgtctactttattcctaataagtttcaccccttattagttatgtttaagttttagtgtctataagcaccttggtattaggttctttgaccctattaccaatgagtagcttacctaagtatacgtttttcgaaccgtataaattgcttaatgtattcattattatttattttatctcgttgataaagaattatcaaaaataagagagtttgctaaacttcttaaatcgtctacaaggcgcagtttattttatttctctgttaaaaatattaaccaattttattattgcttcaacggtaaatttgtacttgattaaaatcaggagtacattacccgtgtttagcttacgatttacgaatttaattaaattggaaatttgattgtaatgatttagatttgacatttcaattgcttagagaaatcccactttattaataagtttcatttacgataaatgcactcgcaaaggacgagtaaagcgcattttagatgtataactgttattgaagaacaattggttctctggattttgattaatgcgacgtacagcatgttataaatcccaatactctttaaagtacccttagcttcagcacgtaccagcgtgtagggagttgcttcccgtgattcatataaggctatgctttgagatgaggcatttagattgatagtttcaactttttatttatttttgtgattgttatttgttagcttttatagttactgatattaaccctttctttttaatc

SEQ ID NO: 2528 - DNA, 905 bp, Heliconius erato iflavirus
  complete genome.1
cgcgggtttatcccgcgcagcgttgtagagcataatttcactaatatttcaaagtgcatgtctattgtaaattatttgtgttagttcagtttgtatgttcctaaaggttcgatacttgttcgtaatacagagatgtttcctttgatggcatgtatttgaatattagctttgtatgtttacgtcatagttttaaaataaattattttgttagttattgtatatattatatcattgtatagtattaataaaatataatactcggtactgaccggggctatatctaacgacttattattttcacatcatgtgttttcgtagtcggcctctatataattcctttcagtgggtattagtaactacgacaccggcataatcacccccggtggcaacaagcacctctcatgtgtttataataagaacgatttatagtgtaaaaataataattttaaggcaagactaatttctattgcaaatgtctatgagtagatgaaacatagtgaagaagtaagtgtgttaaaatagggacccctctaagtggctaaaaccaccgcctactactttttcacgtattatgacataatcgaaaatgaccgctttgtgtagaaagttggtgaccctcattctgtcatggaggtgaggttaatccggctgagtttatctcaaaacctcgatgacatgtgtatccatggatttcgggaacatatctctaagatatggtcggacttctgaaccctaaatttacggacgttttagtaggaagaataaaacgtgtccatttcttattcattttcttttatggtgacaatttattgagtattaacattattttgtttgtttgattctatcacttttacagtcttgtgtattctttccactttattttgaatttattaaatctttaaaaa

SEQ ID NO: 2529 - DNA, 906 bp, Beihai picorna-like virus 46
  strain BHZC37388 hypothetical protein1
tctgtagattcgttcttatgaacgaatctacgcatatgcttgttttggctgcaaaaaacagccacttcgagaagtcgaagccatacatttagtaaatcgccgcactaccgtagcggataaatgatggtggaaaccatcacgaagttacgaatgtatgacaacgcgaagttatttccgtaggagcgctcactccgaatataaaatgagcaacacgtggaaaggaaaaaccacgataaaacaaaccggcaaaccatttgcctatatgtaatttgtctatttgcttttgcaaagagtaaccagggttttaacccactagtgtacaataagtttaaatcgaaagatacctctcgcaaaaacactagcttttataaagaaaacataaaacaaataaaaattatcgttattatgctatctgtatgctgaggtcacagctttacaaaagacctattaggtgatctattcaccttgataggagttaagacactcctccaacaacagtcatcatttagtccgtggctacttagagccacaaccaaacaaaccggagtggaaccggttgacacagccttgtgtgcttttatagcaccttggcactcaccttgtgagtgtgtcaaacctttagagtctcatggatataatacctgagaattacataggacacaaggaattagacgcgaaagtccacctcagagtggtagacgccccttagtttgttcctcctgttgaagacaacctttgacattactttgactagacaattaggtcccgatgaatatagagtgattagactcttgacataggaaagcctctgattgttgaacccttgtaatggataaggaagttggaaatttgagtgattcttggagaaccggtaaaaatagccgggcccttgacttgtaaatcaac

SEQ ID NO: 2530 - DNA, 908 bp, Riboviria sp.
  isolate nut157pic1nc genomic sequence.1
ccgtgggacttttcagacccgagctcaatcaactcgccatgatgcctgcttgcactattcattctacatatggcccgcttctggttttgactaaaaagccaatactgagctgcgtcaattccgataaaccgaactaaatcaatttatcagcacttcgttccagattctgtagggtagaagttacaagactacttcacctttcctagtggatagcacataagaaagtaaacatgcgttgatttgtttttgtgtttgctatattgcttcataggtaaataagagaagaatgggttcaattcaaacaaaagcatgctcgtgagtgaatcgaagagccgtgttctaatattatttagagctagacagcaatatcgtaaacacaaaaacaaatcaacgcatgtttactttcttatgtgctatccactaggaaaggtgaagtagtcttgtaacttctaccctacagaatctggaacgaagtgctgataaattgatttagttcggtttatcggaattgacgcagctcagtattggctttttagtcaaaaccagaagcgggccatatgtagaatgaatagtgcaagcaggcatcatggcgagttgattgagctcgggtctgaaaagtcccacgggtattcaggtgcaggttctcttgaaaggttttacttctttgaagtaaaataagacaccgagaggtgtgtcctggactatgctggttaccttagtggatatggcttgatgaactgagataagcaaacattcgtgtttgttgcttgagcctttgattgatgtatcgattttagtagatggtttgatgaaactcctactgcgagatatattttaacccttttatgaaccgacgtggaatttggtaagaagaaagggcgaacgatggctttttattttctctcatt

SEQ ID NO: 2531 - DNA, 909 bp, Hovenia dulcis-associated virus 1
  isolate DF-390, complete genome.1
cgtatcccttatgggatacggaccttttgttcatgtcgatttataatcagcactaaatacgtttagtaacgccattgtaataggacgcttgtcgactattatatataagagaattattacgcgtatcgtagtgtgaacatttcataacgccattgtacgtatcgtacgtttcaaaaccgcttagatttgttgtcgtacgtgcgtatatataagagaattatgccgtgttctggttatttattgatgtgttcatcaaaaacttttgataaaacacccattttatttcatttgtagatatttcatcattttagcttgtaaatatttaggtaattatattttgaagtgaatattatctgccagggcagcactgatatccaattatctgacctgacagcactgttattcatagatatttaataaaatgagtattatttgcctagacagcttatatctgcctagacaacactgtcactcaccaaaaacattttataaaatagaaaatggcgatctttgcatcttgttgcaattaagccaccaaaaatatatttatttgattaatgacaatatgtagccttttatcatttggcagatggatgaaggattactcacttgttgagcgtaccaattccacccatttgactataataaattagcgtatcatgttatcacccttattgttgttaataacctaggagtccagactcatatcacgggttagatgagataaaactggttactgcgtgtcttgcatagggctgcagcgaaaaatttctatgcacaagtattggatcttgtaaaaattcacgctttgacttttgagcgatatcacggtcacccataaattttcaattgtacaacctgcccacgagagttaacgttattttgtgtttattatacgattttattaca

SEQ ID NO: 2532 - DNA, 910 bp, Picornavirales N_OV_064
  putative non-structural protein1
aatcctagggggcccctattttaagggccccctagatcgcgtgtcgtacgtcttacgacttttcatttattattttatttgaagaatttcctataccgcccttcctggcggtttcaacatcatatgtaatatatttttgtcttaaatttagttttttgatattacatatccccgttattgctcatgtgtgtttctcttgaagattcacgtatttcgaaacaatttagttgttattctattgtcctggagcaatatcgtattcagcaatgcgtttagattatgccaaatcctttggcgataacaaactcagagcacctgtcgcatagacaggccccccattccatgatatcatatcatgttcggataattagaagttccgaacctctagcttttattatgagctgcttaaatattcataattaacccaccccatgcagagtagactgtccaaacatttcgttattcaagactttttatagctcgataaattgtcctctgactctcaatcttatgcgctagaaccgaaatcttagcttagttctgatcatcctatatttgatctgatgactataatagttagactcgaacctcgcttagtctttaaagaagaggtaaccgtgtattatttttaatcttgctttgctagcagattgcttatactacccacggtaatattaggattgcaaggccacattagtgcctcctgtttattacccggtatttcaaaaccacggtctgaccgaaacttgttagtagtacttgcagaaatcagcaacatgaatctgtaagtggttatgctacaggatctttcattaggtccgcaaaactttcttaaggtttcaattcccagcgtcctttcgtcttagttttatactacttcactggatactaaaacagttttaccttaacc

SEQ ID NO: 2533 - DNA, 911 bp, Beihai picorna-like virus 38
  strain BHZC37430 hypothetical protein1
cttgctatgggtcaaaccatagcaagttatactccgaagcagataagcctctcgggagttagtattgaacgattgtccagtgtgacgatttcgaattttatagatgtcctattggagattttctccagtcgaacttactagatattttatttcgtcatatttgggttttcttttagtatatattgtgttaaatcaaacccccccccatttttgagggaagtctttctacgtttttagactagccagcaacaattttgtcactggtgaaccaaaacgacggtatgacaggtttgacatcctgttgagtccgtgcctttttaaggaattgaacgtagagttctcaaaattacatttactgtggtttcaactgaaaagctctgtaagcagtaaaatgtgatttttgatagtgtttataagtaaaatattacttggtttagccgagtcctaggcgaaggtctgtgattagttgacctctatgcgcgacttacgagttgtgtttaagtaacaaggcgtcataggcttagccgcgcttatttgatagacgtgacgaccatctcgttatgttcatatttgtagatctgaagagtcatatcagactgattatttgatcaatcggtgtgcttacgctcaatatatgccctaagggagcaatctctccgagtcttacgagtccgttgagtgagagtgttatacaccaaatattgtgataatgtcatgagattatctactctaaatcttgtgttaaatatgaaccacctcttgattatttgtggttaaaataggcgctttactaaaagtagtaatttgaacagacacatgaaaagtggttttggtgattgccataagagcaaaattttcacccatctaggccgatgtaaaccttcccgtgtggaccgcgtgcggaacggggt

SEQ ID NO: 2534 - DNA, 913 bp, Picornavirales sp.
  isolate coa131shi1 genomic sequence.1
cacctgacgcctgtctcttatacacagcgtaaatcattaaggtgcaattaatcaatagttgcacaagaaatcctgggaggtgactcccaggatttcttgtgcaactattgattaattgcaccttaatgatttacgcctacttggtgttgacacggctttttatttcacgccgacttttttgcgaaacgcatagacgccgcattcttgtcgacacggacttactaagcacgctgactatatgtagacacggatgatttttgtttagatctgactactggaaagacagttgactcaaggaaagacttgaaaaaccccacattaccatacttaattattgtataagtggttttagtcgctgacgtaaccactacctctggattagttttagtcgttgacgtaactattctcctaggttaagtatttcaagaatatcaatcttggtacttttatactttaatttatttatcgataatacattagggtgttgttctttaagagcagcccgaccataagacgaaataggacacttggatatttattaccggtacttctaacttcttattgaggtaaggttttcggaccctcactttctaagatgcattagtacttgttgtaggtacccctgttatcagcctatgcccccgcaagaatcatacaaattcttttgaatacgatttggtttgacgacgaggcgcactatgactctataccgttaagtaggagagggacatttctatattatacttaggttgttaccatctctcttggcatatcggcctatgccagttatagtgtttgtaagcagtacagcgtaagtctgcaagaacttcgtaggagtatacctccgaacctccggttaaaggcgcgcacgataataccggttgcataaaaactgagcgcacaatgtatcaca

SEQ ID NO: 2535 - DNA, 913 bp, Wenzhou picorna-like virus 33
  strain WZFSL76563 hypothetical2
gcccatacacgcattcacgcagtacatagcgtcttggcggctgcgttgggtggcaggacagcctacccgttactactcagaggattcagagagtaccaagacacttacattggcttgtgcgagccatgtatgtacatagtagcacgcgacagatccagcaagaattgaagaatgttccactataagtggattagatgtacccagcaaagtccttgataatgctggagtcctgtttgctgatgaggcgagcatatgcgcggtggggcctggtggctctgagtcctcgtttttgcttgccgactccggtttgcaagatttgaagagtttcttttctcgaccagtcttgtggagtaggtccactttgagcacgaccccggctgtgcttacaacccacattttgacgtggacggagttgaacaatttgactccatcttggtccactaggctgcagggtgtcaggggtattcgtggcactttggtgtttaccgtggaacacaacgctaatccttttcaacagggattgctggttgcctcgtttcagtatggggacgaccagtataggcgggggttacggccatcattgtgtacgcagttgcctcatgttaggttagacattgcgcataacacttcagcatcactcaagattcctttcaggtcagagtttgagtatattggaagcgcctttagtgaagttaaccatgtttatggtactttcgctttgactcaggtgctgccaactccctctttgcccaattcatccttacctgtttttaaggtgtatgctcattgggaggatcttgaggtgtttggtagagtgccgctcaatggcaccacatttgtggttcctcagtccggcgccaatgtcaagccgcgcggattgactccttctgatagggagttagaggataatggc

SEQ ID NO: 2536 - DNA, 916 bp, Plasmopara viticola lesion associated flavi-like virus 1
  isolate1
caggaagttagttattttctgtgtgtattaccacgtgctaggtaacaatttttctattgttgttatcggtatatttgtatttagtttttagtttacattatatgtttagctaagtagcttttaataaatgtctgggataggaaatacctcttccaaaagtagcactaatcagttaggtagaaatttgcttaaacaaacagtgtataatagttcacttctctcttgctattatagacagccagtggtcatttacaatactgaatcgacttgcgaccgaaactttacaggagtatttggcaatatattttatgacattacccctctaaaggaaggcggagtcaggttatcatatcttgaccctttacttgctaggacttacaacgacccgaaaactctacagcaaactcttgtagatcagggtatcaccggaactcatttggttgggaaatcggtggtatatgtttgtgagcaggacccacaaataccagttcctgcttctcctccaggttggttttactctaggtagaccatcctgtagagtcacagacaatcgttgttattgtctttacggtagggtttggattgagaaacctagttattgtgaaggacttgctgattataacagtaagattgtaaaagcagtattatctaccgatctggaaccagatatgaatgcctctcaggcaatttctaagtgtttcggttccccaaagttggagtttgacttcacaaggtggacgccggaatacaaagaaactttatatttgtgttccatcctcttcatatactcattttttatgagtagaaatctaggaatttctggtctgggtttagccgttggcctctgtaccaaagccctagatataaagaaaacggctttaattgttctggctataaccgggtttagaacaaaaca

SEQ ID NO: 2537 - DNA, 916 bp, Beihai picorna-like virus 30
  strain BHNXC41477 hypothetical protein1
ggacgacaccgcgcggagtttcagttctaattgctgggtttgcccccagcaggctttgttccttgcagatatttctgcctagcttgcagttcccgggcaaaacccggataaaactgtattgttctaggatgaaattactgtattgtgatacattgtttattgaattgaaatggagttagctgctccttttttaatgcgtagcccctaggttgactacgtcgtaacaaaaccgaaccccccccttgtgcattggggggcttcggcccctcatgtgtgttttgtatattattgttcccaatgccgtttttgtggccttgtgccgcaggaattgtattcctgtatattattatttaacttaaaaaccgccttgcggagaaaaatttaaattttgggaggaaacatgtattagcgagaaaaatttatattgtatttttatttaactcaaaaatacgttaatacattggtacacacacattgtcaactaaccaccatcgtagggccgcccctacttgtgatggtgtgtgaaatttcagtgcttgaatgactgagagaacctgtaattgtttggttcttaactttgtgtggacagatctcttctaacgccgatgctttaaaagcagcagaggttactaagcggagatacttaattgatctgacagtctcagatgagagactagctggctggaaccagcgaagctaagatcagcctcggaggaaagaggtgaagaggacctaagagggtctagcagatggagtattagcatcgctaatgcgtagtgtagaattgcgaatcttaaatcaatccccccccttcaggtaacgaaggatcaggaagcattatctcattttgctttactgctgctacaaaaagtcagattattattatttgccttatctagtttgtcagtcccccatc

SEQ ID NO: 2538 - DNA, 916 bp, Beihai weivirus-like virus 2
  strain BHZC36779 hypothetical protein,1
gggcgagggtaattttgggtgtacgcttccagcatgccaccaatgtctcataaagcaataaagagaggcagggtttgtggtgtgttgcaatgagcggcccattgcatgtcagcattttgctgagtctttttccgcggtccgtgccgcgatgaaggggagccaccggaggataatgccgtgtggtgagaagaccgctcgtcgactataagggggaatttaccgtctcgcccagtgctgtcgtcgaaagccttgatccagaggttaggtcatccttattcttcaatcccgaccctgtctgcagcaggagggttagagcctggaggagcccagcactgctcctgaggtgtggctttgcgtgtgcgtcgatatgggtccgacgtgggtttgccagcccgaaacacgtaccccgagtcctccctggatatggcacctcgagcgcgagaccattttggcacgcgagtaagaggaacgtcgaagctggttgtgcacgcgtaatcgtgcacagttggttaggggaccagaggtgatgactacgctcccgcaggcagcgtgcgacaacgctgcggtgacgaatgagagacgaggtgaaccaagggctgcgagctccgagccggcccaagtggctttgggaatccttgtcctgtgaggttactctcatgtcgaagatcccgctttcgcgggtgaccgccctcaagtcaccacccatgtacagcatctgcagcgtcgcgtttccactttttgtctaccacggattgtagagtggttgcgcgatggtaccacggaacaaaaatcaaataaacaattgaaaacctaaatgcaaagattcattgttttgtttcggcgcaggcgatccccgcctgagacggagtcactttgtgacagtttttgtttgttttaaagcgcgtcggttttgctc

SEQ ID NO: 2539 - DNA, 922 bp, UNVERIFIED: Potato virus S
  isolate 18-1113-2, complete genome.2
gttcacaggtaaaagctcgaataaactgtttcacagagagaatgccgcctaaaccagatccttctagttcaggggaggtgccacaagctgtgccacctgcaccacctccgcgcaattcggaagggcacagatccgcgcaatcggaggcgccagggcaaaatgaagaagccatgctggaacaaaggctcgttcgattgattgagcttatggctaaaaagaggcacaactcgacattgagtaacatctcctttgagataggtaggcccagtttggaaccaacacccgagatgagaaggaatccggaaaatccatactctcgattctcaattgacgagctgttcaaaatggaaatccggtcggtgtcgaacaacatggccaatactgaacaaatggcacagatcactgcagatattgccgggctcggtgttcccactgagcatgttgctggcgtcatactgaaggtcgtgatcatgtgcgcaagcgtgagcagttctgtctacctagaccctgcaggaactgttgaattccccactggagcagtccctttggactccataattgcaatcatgaaaaatcgtgctggactgaggaaggtgtgcaggctgtatgccccggtcgtctggaattacatgctcgttcagaacaggcctccttcggactggcaggcaatggggtttcaatggaatgcacgcttcgccgcttttgacacatttgattatgtgaccaacggcgccgcgatccagcctgtcgaggggctaatccgtaggcccacgcctgaggagacgatagctcataacgctcacaagagcatggcaattgacaagtctaacagaaatgaaaggctggccaacaccaacgttgaatacaccgggggcatgctcggtgctgagatcgtgcgtaaccatcggaatgcagcaaacca

SEQ ID NO: 2540 - DNA, 922 bp, Grapevine leafroll-associated virus 1
  clone a, complete genome.1
gtattgtcctagtaggtatcgaacccgacaatcccaatcctaccattgctttccatttcagatctgaaatccactcttcttctctgctctcagctctcgggcatctcttctcgctttccttcctcgttaagacgcgctgaactacagttcgtctgtctttcctcatctcaaccgcttcttttcctttttctctcgtgtcttaactacgctctcctctagctcattttctccctttactttttcgtttcctttctatcaggggcgaaggtttttcttcatctcttaacctgtcttttcctcattctgctttttcctttctttctcgtcttctttttgtgtcgtaatacttcttcgcatactctcttccgctttcatttcctttcatcactctttctttttggttttctcatctcttctctttctactgcttttctttcttattcctttcttatctctctttacctttgtttcttctctttgttttacatatctctttctttttattttccttatttcgttttgtttcagcgggttttttcttcttcttttctctcgcactatccactgtttttccttatttcttcacttttctaactctcttttctacacgttttccaccgtctatttttatcattttcctttttgttcgtctaggttctcttcttctcttacccaggccttttccgcatataactaacatttcctttctctaaggatcttgggttttgtttaactgttgttacgttatcatctttgtgttcggttttcctttctttaattttagtttacctctttttcttcctacttacttcttttcttttattttaactttccttttaatttttctctcttgcttagcttttctttcttttcgtcgcctttatcttttactcttttcctttcattactttcaacccaaaat

SEQ ID NO: 2541 - DNA, 922 bp, Riptortus pedestris virus-2
  complete genome.1
cctcaaggcacgcacgcttattaacttatcagattatatggacgattatcactagtattgataccgctaaaccaaccctctcttcttttaagattggaggatgctttagtaggctctctactactgtttagtctaaatatacgctggtatgacctttatatatttaaatatccttttataattaagttaacaaggtggtaccttaagtagcaccattaggttaccctatagtcgtaagtataggttaagaattttcttcttaaattatatttaattttagttgtagatacccaaaaaaaataataaaattataaaaggctttgccacaaaaaaaattacatttagatttttgtttatttttgtatgcatattttttgtttgttcttactaatagaattaagaatcaaacaataaagtagcgctatattttggccgtttctgtaacagattccgcccgagtatagtatagtggttatgagtcggagttccactataaaccaactcaaagatcgcttagcaccggtaaagtgagcggggagtgaacagcgaataaagtagctgtaggcaaccttggctcggcctgcacgtacatgtctatgttgtaggtagtctaaccaactctattacccgtggtttgcatcggaccctctttggatgtttctaggaccccttacaggtattaaagtactgacaatgagagtaacactaaacactgttagacgtaggcgcggttggtttagcagcaggaagtagtaaacctgttgcgtcgcgctcaattgaggcgatccgtaattgctggtccccgttagattttatcgtagtcgaaatctaactatagtgtttattgtgaaatcgtgaggaaatttgtcttgtaagtagaaaacattcaccttcttttttctctttttatggttaaatatat

SEQ ID NO: 2542 - DNA, 926 bp, Unknown
  Description of Unknown: Translation control poly nucleotide.1 sequence
gaacaaacgttttaccggtttgtaaattggaattctcgaattcgccagtcgccttcttcgtatcaaggatctggaatttgaacggtatctttatcattttaatttctacttttcgtaccagtcatgggttttgtcaacttttcgctttttgatgtggacaaattgatggtatgggtgagcaaattcaatccaggcaagatattgtccgctatttgcaacttgggtatagactgctggaaccgttttcgcaaatggtacttcggtctcaactttgatgcacatatgtgggctgtcgatgcctttatgccactcatgccacattacacggagcagatggaacgcgtagtcggcgacctctgcagcgaaaccctagaatccaaattagaagactgtctggaattggacacttccgtcaaccagtattttgacgaagaagtgtacaaagaggatgacaagggcgtgatgaaactccaaaggagtgctgccaggaagcacattaaacgtgtgcgaccaggtatgatgacagcagccataaaagctgttgagacgaggatcagaaaccgccatgccattttcggagataacatgggattgatagacgaagctgcagttagagcaactgccagtgatatctgtggagagttcaaaataaatgaacaccacacgaggacattggtatacaccgcagcatatctttccatgacacctgaccagaagtccctagacagtgtcaagctcgcctataatccaaagagtcaagccagaaggactttagtgacagccgttcgtgagaacaaagctgttgctgggttcaaatcccttgaggatttttaggcggtccactcagctttccggttgaagatgccccatatcctattttaggcatcccggaaatcagggtagctgagaagcgggccagtagagtc

SEQ ID NO: 2543 - DNA, 928 bp, Solenopsis invicta virus 8
  isolate Formosa, complete genome.2
tgagaaatacaacaaattttgtacaagctagtttaactattcaaattacacttgctatgactgtgatgcgaaagttaaatatttctaagatttacgtatatgacaattcacacttctttgacaatgcaacgacacacattacagacaacgtacgatactctaaaagacaggaaaattacgctgtcctttctaaagccgcccaacaaactttaacgaaagaaaactatcgatctcatacgaatcatactcttctttcagatcatataggtttatatattacattgtaagtatggatactttgatcgcagtttgcggattgttatccattaggttaggaacagtaagcccattgctgtggttcagtaatgcgtttcatctcaacaatcccgtaaggtttgatggttgagaacctctgccttggcgagctttggtctattagttctagtgcaattgctgcagtacagtcagggacccagagagtaatcctctggtgttctaaagtcctgaagttgagaaggactagcaatccggatcaaccagagtggaaccctttaaacgtggacgccaccccagagagctccgtttatcgtgtcacctgcagtaatgaatggaatgaatgatagaagcgacccacctagggacccctctaggatagtcatggtatgtcatgaaagactccatcactgggttagaacgatctgttcaactggctttggaaagcttggcttgagcttatctagtctagggccagtataaaatataagccggcttcgtactgggacacacaagccgttagacttctttttgctagtctgtgagtacccaatttttacctttaaatttatgctgtcttattgctatctttgtgctgcctttgctactttactgctgttatttgtgccaaactactgctagaataatcgttgct

SEQ ID NO: 2544 - DNA, 930 bp, Thrips tabaci associated iflavirus 1
  isolate ThassRNAV51
gtacgtatttcgtacgtacagatccttgtaggagtttcaataattgttaatttcagagttagggatattcccgccgctagtattcacaatgaatctagtcgccagtttatctaaacctttggggtttctcagttatctttcttcttcatttccttttccaggatctcacaaaattcaatttgttaacttcaattttaattttcaatttgagattttaatctccaaaatttcttctaaattatgggttttctttcccgtgtaattttcaatgttgttgtgttttgaaaatcagaaaatcaaacaaagatgtgaatgtgtgtgtgaatgtgaacaagtcgagtgattctcgacagcgtatttctgacgtttaatacttatattaagattagttgaaaaacagtcgtcctgagtagcagtaagagcactagggccattttcaaaggcttaagagatgaactcctgtttctaatcaattctatgggagacatgctcttaagttgactggctaattgaaattgagtattttagtttggattgtgtggtctagttggacagacccctaagggaagtgccagtacctagaaattcgtaaggctatctttgtaccagctatatcgattaataaccggtatagttacgtctgggacccctagagggtttgggatcggcgtaccatgcagttttagtggcttcggcacttacttaaagtatgtgggaaccccatggaacttaggtagagcaagcgcattaattttgcgtagtccaatatagggacgtctattcctcctagagggaataggtagagagtcaacaacgtcatagacgaggtaattccgccataatatagtctggacagctagaatatggaagggcatctctacatgtagggatgggctctcaaaaccgatccggtgacgcaaggctgcctta

SEQ ID NO: 2545 - DNA, 935 bp, Warroolaba Creek virus 1
  strain WRCV1 205652 hypothetical protein2
taaaattttattcgcgatgaaacgcctccttcctgatgcacatcaggatacggagaagatctctgagattgttagagataagaatacaacattgtacggagctattagcgaggttagtaacactgacgccctacaggttgatctctcagagttccgagctcttctccgtcgctttaatgaagacgttgaagagtttcggggtgcgcaaaagttcttccagaccactttggattctttaggagggactgtagatcgcctgaatggttcttttgtggacctcaatgcttccttaaatgttgtaaaagaagatgtcaaacagctagatatagctgttgatgacaattcaaaacaaatccttgttttgatagacgagaataaaacatatgagtctaagttggaagctcttgataaaagagtttctaaacttgaagattctaatgtctcgataaatttggggatttaatcatgtttgattttcttaaaccatattttaaacccccgcctcgtaaggttttctctcgccctatggcccgtgctgccaaggatgagagtatttctgatgttataaaagaacgtaaccttactgagtatcaagctattgaacaagtgttctctgaacgcttatcatcgatagagaccttctccccgtccagacgatttcttcctctacacgacgaccagaaatataggttccatagcctaaaacttgagcgggattatgagtatagtgttatcaaaggtgttctctttgatcaggtctttttcggtacaacaattaagcttgacaacttctctgaagttattatttacccttccgatccagaagttgcaccatctgatcctaaatatttggatacagtgattattatcctggtgaaggtgaatggatctgacactccggcatccggagtgtataaaatttacagtctaatata

SEQ ID NO: 2546 - DNA, 936 bp, Lymantria dispar iflavirus 1
  isolate Ames, complete genome.1
cgattgtatcagagttttcaaattaattaatgagtctcttaagtgagttttatatttcttgagtttcatgttccgaaaaggttcgatgattatactcttggataatatttaatgacatttttggattggctcattattaagtcttttctctgtacttagttaaggtttatttgcttttaaattatatatattatacaacttatatgttttaaaaattgaaatactcggttcagaccggggctatatctaacaacttgtaataaagaatttacctattttcactatcggcctctcttattagtcttttagtagcatagagaaatagtgacatgagcataatcacccctcatggcaacaagtagctctttattttctattacaagtatgatttatagtgtataaaaattaattttaaggcaaggcaacataatattgtagatgtctatgagtagataaaacgtagttggaatgtgtgtgcgataaaatggggacccctccaactggctaacaccagcgcctactacatttcaacatattgcgacataatcgaaaatgaccgctctatgtgttatggttgtgaccactattctgatttattttggaggtagtgttaatccggctgagtttatctcaaaacctcgatgacaagtgtatccttggacttcgggcatatatctctaagatatagtcggacttctgaaccgtaaatttgcggaggctttaagtacgaagaataagcctgtccattttcttttttctttttcttatggttacaatctcagaatatactaaagcgttttcattgtttattgttatttcaattattctcaattgcaatcctattacccctttgttttatttttattccaaccttataattcttttgctaattgtttctcatactgattttaaatttgtatcaaaatatttttgaag

SEQ ID NO: 2547 - DNA, 942 bp, Hubei picorna-like virus 52
  strain QCM127295 hypothetical protein1
tagttgatgtttaaacatcaactatacgcgatatatggagcttggtatgctcctaccaatttaaaactagtaccaaataagggctgaaacaatgctacggtgcttattggaacaatactaggtaattactactacttgctgaaacgtaagatacggtgagtactgtaattttcactttggtttcaccaaacttgggtaacaccataaccttcagtatgaattttgtatgaatgtatgaatgaatattgagtacggtataccgaaagagactagaaagttgcataaattcttgcaatttggtgggattatgacacgaccaccacccttgagtttacgaaccgaggctttgtttgaaatctctctaggtattactggctgtgggtatatgaacttataagtaacagcatatggaactcttagtacgcttgggtagtatgaggagccgtggggaataaacttggtccacagggagtagcccgaacgctgacctgacgataggctgctatgtccgactataaacctattcaattaggggtggcacacaccatgcactagtgcgggacaggaacggttgacaataaggaggccttctctaagcccttacgggggtgaggaagcggaacttcagaacagcttgcggaaaagaaggaaatatggtctgagaaagtaacttatatgcgacgccggcccttctagttaaagggaattgcctatggacgagatagattaggtaattaccatcggcggctgggtgcaccgatacatagtacggagtgcgcttcacagtggacttatctacacagtggagtggatcttagcttagtggacagacagacgtactaagcgacctagatctcccaaagataacgactttatgggcgtagtccggtcgtgcaggggttaccccgcggacaacgcaaattttcttccaaactttcactt

SEQ ID NO: 2548 - DNA, 945 bp, Fusarium poae mycovirus 1
  genomic RNA, complete genome.1
gcgaccgttctttagatctttcgttcggacccccccagcccctggcggggcgtcaactttccacacgtcttagtttgctaagcggaccagccacaccgacacaaagagcttcggctctgggaaacagggcagactaccgcgatgtgcttacgatgatttgtggttagagcgcgcctcttgctaattctgaggtggtgccgcgcgagctttaggcccttttgttcggaactccaaaaataacttggctttccgctcagccctgagacaatagggttatccaacgacttggctattaatataacatcctccccactaacgaatcgcccttacactaacttagggtctttccgggggaaaggaacccgtaccgccatatttcaaaacacatggcttttcatggtccggggtcgttggagtaggtatgtgtgttagcggcagtgagtatatgaagcggttcatcgcggatttcctgctgagcaccctacgcccgaatttttaggaagaatggctcttaagaactaggtagccattctgcccttaaaatttgagggtgtggttatacgcgtccagcatgacgttaaaaggcacacttcgccttaggacggcgaaaaactcagctctgtagatctagcccgtgatccttctgcagtatcaacatatcgggaataagcatcctgtcgagttctggaaagcttgaactcagcggtggggtaaccaaggtacgaacttgggtgtgaagccattcaagacgtggatggtggagctaacgtattagtggatgtcatggtacggggtataggtccgggattaaccacccgggtgaacactaactcgccactacgaacgtgccagccttcgggttggtggacagactgacactcaccgcgccaagtcccggctaagggcggcgcagcaaacagtcggcgtgggaattattaccgcgtg

SEQ ID NO: 2549 - DNA, 945 bp, Nesidiocoris tenuis virus
  isolate SDQD, complete genome.2
ggtcaattaaggtgacgaagatttcgtcattacacgaactgccggcgccgggaccgaatgtccaagtcttgtgcttcaaacagtccgaaaagaaggagttgaagcatttgaacgcagtaactatccatgaattttagggtcaggaaagtgcggtcgtctggatcgtgagactatcatcgctacctaacgaacagatctgcaagagtgaagaacatcaggtggtggggattacaagacataagaaagagttaatatactacacggtcgtagaagacgatctcgcaagattattaacccaccacatagacgaaaccacactcaactccgccgttgggtcgttgaaaggaggaatgcttgaaattcagagagacgaagctattcttcaatcatgggactgtcacgatgtctctttcagagcggccataatcgattgcggggaagaggacctcccgtcgacaaaaatttcggaacccttcaaggaaccactcgcttgtttcaagcccggtcacgttactgcagacatattttgacgatctttttcctggaagatcagctgagatccatgatttcgaccaatacctttgcgaaaattccactaaatcatatgttttggaaaatgccagttttgggggaaaaggttgggtacctagggcacagttatatgataagaaaaggccctctctgttgacatccattcaatcaaaaagggaaaattccctaaatgaggtcttacttgcctttcaaaagcgcaacggcgcggtaccggaattggctctggattccgctattgaccaagaagcgagtgttttggtaaaaaactttgtaaacacagcggtggacaagtcaagattggatttgctgagacagtttcgagaggaccaaactgtgctaaattcggcgcagattcgagaatggttggactcacaaccacccggagtcgaaaac

SEQ ID NO: 2550 - DNA, 946 bp, Hepevirus sp.
  isolate RtCm-HEV/XJ2016 non-structural polyprotein1
gaccatagcccatgggagagttggacaagggatatccgcatggtcaaaaacaactgtggctctgtatggcccgtggttccgggcgattgagaaggctattgtggatcgactgccagacaatgtcttctacgcagacgcccagaaccctgatgtttttaatgcggcagtctcaggtctgacaggctatcaggtctttgagaatgacttctctgagttcgacagcacccaaaataactattcgctgtcgttggaatgtgcccttatgactgaggccggcatgcctgagtggatggtacgcctgtactggctcctccgatcagcctgggtcctgcaggcgccgaaggaggggctcaagggctattggaagaagcattcaggtgagcctggaacactgctgttcaatacggtatggaacatggccatcattgcatactgttatgattttgttggagagtgtgtatatgcttttaaaggagatgattcagttgtttgctgccaacgttacatccggcacggccgtgcagacgtcttgatcactggctgcggtctcaagttgaaggcagcctgttcttacataggtgggtatgccggctccatcgttgcctgcgggtgcggcgttgtgccggatatcatcagatttgccgcccgcctgacggagaagaactggaaaatcgctgataatgatgatggtaagagggcggctgagttaacaacagcagtgaaggatttcctggcaaaactggagaacgtgcatcatctggccataactttgggggcccgctatcacaacaagcctgtcgggctgctagtcaacctcgtcggtgccctcaaaacaatcgccgagggcaaaggccacctgaccaagcagattttaccaatcttgactctattgaaggggtttgaatgaataacatgtctttttgtgtggtatgagtgggtgtgcaga

SEQ ID NO: 2551 - DNA, 946 bp, Redbank virus
  strain REBV 205543 hypothetical protein gene,1
tacacatagtcaataaagaagaatgggcccccatccttctttattgactatgtgtattattttatgactagctcgtttaaccttccagcggaagctctgtgccagtatttttcatttaggtgcatgttagcatttttcttatttgcccacgtactctgtaattcattaaccgaccagcggtcgctctgttggattatgactgtgcaattttgttccctcttgacaatcttattcttatttgatgacgactttttaggccctcaattcttggattgatattttgttactacccggatattattatgatcttgtatcagaaccacgccgataagctcggataatattatccctggctctgcaatttattatgacgactattgagatgaacactattggactatgacttgacttattatttgttatttgtacgttagaatcaggcaagcttgcctatcctgtttacttgtcgattaatctaggactgaacgttaatacgaactacttatcgagtaggtaacccactaccgaaattgtggctaacccgaaacattaagtagaatttttgtatcgattattaagaactttgattatgaaaccgcactcagtgacgcaagtaatactatgaaagaagaaacggcttttatagtgattaggacgtgaacgcaaaatcgtaatgtttgcctatacattgacgatttgttctgtctgagtagttattacgttatagaattcctaaagtatcttggaaccctcgtattactctcacacttgaggaggtgtgttagtattaaggtaatccattgatatgtgaagaattcgactaacggtgttggtatgttaccggtaaggtttgtactatgatgtacttaagggaccagttaggttaactcttggtgccacggccaagacccgctcaacgcgcataccgcatgaatggaaatatttt

SEQ ID NO: 2552 - DNA, 950 bp, Ngewotan negevirus
  strain Nepal12 hypothetical protein 1 and1
gtgtcattctgacacacatcactcctctgtcacctatgagttttacaacatgacctttgtccctcagtcccttgctctgcgcgaacctcttcgtctctacaacaaggagtttaccgtcttgaagaacctcgttcccgtttccttcttcgagtggttcttccttgtacgttcagacgataaccgatttggtattgtgcccaggatttgtgacgaactttttcgcaactcaaccaggttgccaaagaatgtgcatgttagacgtgagggcaacgagttctgttttgttgaggtcagccacgactcctatacgtgtactcccaaactttacccgaatgttgcaactttgatgatggtccatgactttcctgttgatttcgacgacgtgcctttctcgcagggctcatacgcgtcgaccaacaataaggctatgggcgctgatcagtacctcgccaacaacgtcgcttctaaagtgtatgtcgttgacaaggtgggtgggtcttatatggtcacttatgacccccaagactactctggtccccgcttcattgttcgcagccacgggcatgttcccacggagaaaccgttctgttttgaccttgctacacactacgcgtcgcccattcactctatctttgcacacgtgacgaagttttttcacgaagcgctggtgtatttgttgcagttcctgaaagagatcgccgccgatctcgccctggtcctcttcaaagtcatcagcgaactatttgagattctcatgtcgatcgttccgtacaattcacatttctacactgcagggcttgtgtgtcttttcacgtatttccttttgcgtgacttgctcatctcgtccgttgtgtttttctgtgtgtacagttttaaaatctacactgattctctcatataaatgcttgttgaaactcttctcattttcttcgcgatcctcgcatactgcc

SEQ ID NO: 2553 - DNA, 950 bp, Shahe picorna-like virus 13
  strain SHWC13556 hypothetical protein1
tatgggagcgcttttgcgcttccatatttctattttaaatacatcttcggtactttagggctctcctttaatgttcttgccttgttaattcaccaccattactgcacccctatcttatcagagtgactcggttacttagatgttctacttaaccttgccccttatggcaacaggaaaagttccaaaactgctcgttccgggagattcccatccggtaaaaacccaagaccacactcaacatccggagtgtctaaacccaaggacgaccattgataatatttgtaaaattcatttcaacgtacttattttaaagcatcaagcgtcattatgtcagttgattaattagtttcactgattaattgagataacaaacaacttcctaaatttattttaagtgttttgagttgaagttcacaaatattatgcgatcatattactaatcaccgcctatttccatatcttccgatgaattccgtacaggaatgtaataatttttgttatttgtatttaatttataactttgatctatgctcatcccaccgtttagccattattaggttctgttatgaaactagtaattattgtttgaaaaccagtagttccagcgcgtcgtggcctattgacccccaaacaaagtctttgtctttccctaaaggtttggtcacctataagtctggctctaacatcgagtacagcaagtctgcccaacatttgttgcatctgactctgggggcaacaaatgtggcgggataaagttacaaacctgataacacaggtagctttagcacaaaaccccacattcccacccgagtaatgtcaattttattattttatgcactttataactatgttatggcaaatttattataaaaatgtatttcaactatccaccttcttctttcacctttactgtcgaaactcttttccagtcaagaaaatcttaatgaaaa

SEQ ID NO: 2554 - DNA, 952 bp, Beihai weivirus-like virus 21
  strain BHZY60867 RNA-dependent RNA1
gtccgctgccgtgcagtttaattaattcttttcgtgtgagctgcatgagtcggctccccctgtggggggcattttgtggctacggccacacaattacccatcggttgacacagagccggtggggtccgtgcgttacggtgtgtgcttcgacgggcgcacactggacgaaagagtgccgctggcgcacggatgcgagtaccgttccgagcttagagctttgctcggataggggtggcggtggcgagccattttggctgagtgacgtcatcggcccgagccataccccgaaggttgccttatgcctcagtagccgagggtagttcggtgaagagcctggaagccgggtagcgccggcgacggtgagggcaccgctgttaaccctgcgcgtgggttggccccttgggaggggggctgtaaaatggcggttctgttgtgcgagtggtggctcgaaggttctgggacctgctagtccggctctgcggcgttcactgcgtcgcatccgtgaagacgtggggaccgttccggatgttccgttcacgtagcgcgcgtgggtggataatcgccgaggaagccattttggcagaaggcgacgcacaacagacaaaatggactggcgggggttacggcccgcttttacgcgttgcaggaggacgccccctccatctttcgtggctcacacgacctagttttgcacgcccggtatgtttgtgggagtagtgacccgtgacagacccgtcgacttcaagtcggcactcaggaagagactggctcacccgtggttttgagcctgcttccgtaattaactacttaccctaaaacgagccgtgatttctctggtgggggccagagatttccttcaaggtgtatctgtgtcgcactacggctcatcacgttgcgtgtctggctgtctttgtcatactgacgccggatttgtcgtgctttcgttgtgaca

SEQ ID NO: 2555 - DNA, 955 bp, Apis rhabdovirus 1
  strain Apis/USA/A, complete genome.4
agtttcctttaaccctatctctccaacctgaacaagcaaacacacacgctccgccaacatagaagacagagagccaagacaagtacaccaacgcaaccagcaacttcttcactttcaacacaaaaggaaaatcaacacggaatgttcctgcgaagcatcattccccccctccgcacacccccaattttgggaaataaaatagctttgatcaatagataatccctcacccgaaatcggaataccgcacaacaccctcgatcccaattccctgcaagctccaagcgatccagtttaagccaaaccacaataaaacccttcaagcgacaaagataaaggaccgtcaaacatagacaaaagttcaccagacccgtcacaaaaccaaagataacgacactccgtatccagccatccagttagaactttatctacaaacagttgtaataattcttatgatctctatggtctcattatccccagaatatgtctctcacaaagcaatgccagaaccacacaactatcacaccaaaaaaacctcggcacaatcaggctcattaaacaaaaaaccaagaatttcgcaaagatccagctccctcgtcaaaactccaaaataaaattagcctggcaagtccacaaaacaccgtcacaaacacatcccagtatatcaccaatatctgcccccacacacgcccctccccaaaaaagacacaccagatgtgataagcaaatccctgtcaattttcggcaaacaagaccccttttgcttctttcacaaccaaaagcaaacaatcggaaaacagcccacaaagcgaacacccatcagcatactccggagttcaataaggaaatttctaaaacagactgtttcatactgcaacagtccaattgaacattacattaccaatttatttgagaggaaaatatataaattgcacaatagacatttaagaaaaaaact

SEQ ID NO: 2556 - DNA, 959 bp, Forsythia suspensa picorna-like virus
  strain pt110-pic-2-NW genomic1
tggagatccctctatcttgcgagtcactcaagttcctggtcgtgtcgaatatgattggcctggttggagatttggccatccaaatttttcttctacaacatctgaaattttggaaaaaccatttaaagcggctcaagcgttagcaagtggtggtgttcactttgacaaaaatggacacgctcgagtggaaattccatattactctaaattcgaacgcttgtttactcaatcaactaatccgtcgaataaggatgaccctaacgggttccaaaaatctatatctttaacagattctattggtatggtgtatattactgggtcttatcaaatcgatggtacactcacattttatccgcgagtgaccctcgagattaatcaggcgattggagatgatttcgaatttcaatatccgaaagcagtgccttgttttattgtagaatggtagttgttatattatgggttcttggtcttgctctgttattatcatgtatccttactggtataataggttattattttttaagattagtacatagaacatataattatacatgcagaaaaatacaaaaacatacatttagcttaggtgatgaggagatggcgcctatttataagccaactactcatagtgttcttgttccagtgcccttgtcctgacccttagtaccttacccagcatgaacgatctaagactaaccgagtggggtgcgagattaaaacttggtaacaagttctctcactatgaagccggggtctgatttagtagtgtgacaagtgggaacctggtgttcagcgtgctggagtccataacctctcccaatgtaaattctgcgtgaggcattggcaaagttgtgggtggctctggtggtccagtccggagggctagaagtcttcgagtccggagggtatcgtcaccgcccaatcttgtgacgtctttcttttaaatttactctacaatc

SEQ ID NO: 2557 - DNA, 969 bp, Pink bollworm virus 1
  polyprotein gene, complete cds.1
ggttaatcccgtgcagcgctctagtagtatttcaaattttgaatcgttacagtgcatttttgttgactaattttgttatctagttcattgtcagttcgatttatcgttcgtgactataatgttcgtagaattttcacctttagtcttcgttaaatgtattgtttgttacaaaattctttgactactaaactttaggttagttatatattatagttaagataatttatatatatattataacgaaatatagtattaataaaatataaaatacaaggtaccgaccttggctatctctaacaactattaatgtaagtgttatgtattttcactgtcggccagtccaagctcttcatgggcgagacaaacagtgacaggagcacaatcatccctcctggcaacaagtacctctcacacttttattaatagaatgattgatagtgtataaataataattttaaggcaagattcagattgtaaataatgtttataagtacatcttatactcctagtaagagtccttaatatatatagacggtatactgggcgtaataatggggacccctccaacctgcaaacacaggacgtaaccagtgacgctagattatgagtataagacgaaagtgaccgcttatttatagtcgtggatgacagaaattctattagatagattttcttaaacgcgttctgatcgtgagaatacttttgcgagttactcatggcggagatcgtaagcagatccagactggttacggtacaatacctaaatgatcttacagtgataggtattacgtgtcttactggcatcgagttcgactgttacgcggatgaagcagcgtagctgaatttttcattttctttcttttatggtgacaagcgatattgaaacattttcgatattttccaagtgattaattgcatctcttatttcatttttaattgtgacttatattatttcaacaatcatcaaca

SEQ ID NO: 2558 - DNA, 970 bp, Larsen virus
  isolate Antarctic83 RNA-dependent RNA polymerase gene,1R
cattttatgaaattacgacagaaggctttatcaagctgggaaaggccaaaggttttggtttttcgcagaacattggtaagccataccatcaatcatatagggatctgtattcaatcgaatggttggatactgtgacctgctatgagtggctgacgactgagttaacccttattaatccgaaggccgcttacgctaaaagtttgggcttaacaaacccatttcttatagtgaatgacctgatcccctggtcctttgtagtaaactactggactggtcacgagaagtggctatcctcactggatgcctttctcggactgaaacgtgagaacgagtgtaaaacgacaaaaatcgtttactacactgagtactcacgttgggataatcggaatgatccgcccactagggaggattatttaggggactacacgaagttcgatagaactgtcgaggagataaaagctcctgggcttacagacagagtgaaggcttggcctttctcttcgcagaaaagggccgtcaacatgtctgtcttaatcgcatcacaatttagaaatctttaattcctaaaaggagtacaattatgcaagctaaaagctttacagttacaggcggatctggtgaactcgaatttgaggttctatgtccagcgggcccaaaaagccctgctgaatttcgccttaagaatgaggagaaatccccactcttagcaccttacctttcagttctggctgacaaagtgaatcgatcttcctcacggaaggtttcaattctcttcgttaagccaattgaacaagaaggacaacgtgtcggtcaaaacgtttttaccgttcaagcaaaacttgatctgcgtagaagcgtcaccgatgcgaaaaaggacgttgaagatctactggctatcataaaccaggacgacttcaaagaaatcctcgcaaaagcaatttcaccaaattaacaaccggagttatttatt

SEQ ID NO: 2559 - DNA, 971 bp, Psammotettix alienus iflavirus 1
  complete genome.1
tctttaactcatcaactgtgacttacatatacgcaagtatccctgtaatttcatcacattgatgttaaaatcatagttaattactgtaagttgaagtatccctctttgaaatactatacaactgagtaaccctgtctatgatcttaggtttaagacttagttttaagaaatttttatttttaataaccaatttgtatgaatgttttcatgtatgatacgctgcaactccaataaggattgtacgtgaatgaatgttttccaaattgtgtgaatgaagcgaagctcaaagaagtagtacgatttattccgaagctttgagaagtagtagcttttgtatgcttgacgtaacgtatgtttgttttattattaatttgtgtgttttagttttaagaagttctcaatttattttcttacttcatttgctccaattatttgtttgagccaatttgaaactgcatagtctttattaagttacaaagtttaatttatgcctaatactgctgattcccagccttagtagatcttgatggcaggcttccaacttgttggtaaaacaagatatcaagatctcttcttctacttttacagagctcagccttacgaagcgatgtgatagtttatacttgtgcctagagcgtaacctctgtactcatagaaatactagttagaacttgtttcttgcgttataacgtattgttgagatatcagagcatcgtgtcgacttgttttctattgcaccgtgagatgtaaaacctggtaaagctgtaaaactagagaagaaaaatacttcggaccggataagagtaaacttcaggataagtccccccctggagctaggtatattttaacacttataaagattgtatgttttagattgaggatggattcttttgtatcacgaccactgctatggaccttgactaagggatgtgtgcttgcactgccctaattttttgaatttgttttatgaa

SEQ ID NO: 2560 - DNA, 972 bp, Lucerne transient streak virus
  isolate LTSV-Can, complete genome.1
gtaggcacggcgatcttgtgtacatagcagtagcagaaaggctaatagcgctgtccgaggccgacttggaagcccatccgaagcccagcgatttagttcgtttgggtctttgtgatcctgtgagattgtttgtaaagaatgagcctcaccctgccaataaggtgcgggaagggcgatttagactgatctcatcggtatcgctggttgatcaactagttgaaaggctgctattcgggccccaaaacaaggcagagatcgctttgtggcagtcggtgccttcaaaacctggtatgggattgtcacagaagtggcagttcgaggcgctgtggaaagatttgcaaatcaaacacgccagtgcccccgctgctgaggcggatatatcgggttttgattggtctgtgcagaaatgggagttagaagctgatgtgtgcatgagaatagaaaggggaaacttccctgcaagaatgaggaaagccgccttgaaccgcttcaagtgtttcgccaatgctgtgttccagctaagcaacggcgagttaatagagcaaggcttaccgggtctaatgaagtctggtagttattgtacctcgagtactaacagccggataaggtgccttatggctgaaataatacaagccccgtggtgcatcgccatgggagacgactcggtagaaggatatgttgagggggcccgtgagctctacggagaactgggtcacacatgtaaagattacatcccgtgtgctgctgagggagagatcctcaaggaagtgaacttttgctcacacagcatagctgcggatcgttgctatctccaatcctgggctaaaaccttatttagatatctggaacaccctgacgactttgaggagttggcagtggaattgcagggctgtccgcagtggccgcggatatacaagtacttacgtcggattggaagagtctccgacaaaattcccgaaccaagagaagaaa

SEQ ID NO: 2561 - DNA, 973 bp, Beihai picorna-like virus 51
  strain SCJXSX38939 hypothetical1
tgcagggttaataaccctgcacctcgcgattgacgatttggttagattgtgcgcattatgttgaagattcgggctgacttatctttcgagatttttcagctcttcttattttcatatttttgcgtaactttttagctttttctgatatcctagggcttggaagtgtgcccagattttctatacacttaccttcagctccgttcgtgaacttgcacgttcggttctatttacactctcatgaatactgtagtgatgagtaaacaacacagtactaaagcttcgctattcattgaagctatgacaagataaatgtctaaacaaaatgacggtaaaactctacttagaagtgattccgtaaccatacgatttggtaaatatgaatagcaatttttgtatttttaatatccctctaacccagggatttgtatatgtatatattttacacatgttgtagagctcttgttgggctctttaaagaacagatgattactagtggagataaaaataattcgaatgttacacaagtttttaaataaaatctaaaaacttcactagttggaacctcagcgcggatagcgattactgatcgagaaattcgtaccactttgtgccatcgatatatcgatcttatggaaagcagcaaaccatggcgatccggaggggatcaccgcgttgagaggatggtgtgcaacttgactcgtggaggctgctttgcagtcggtcacgtaagagatctgcatgtcatgaggtaaagtcaagcgtgacctaagcgcttgcgaccattgatcaggttaaaagttcgggtggggcagctggtacagccaggccgtaggggaacgggattcggagaataccgccaatcaagcttcagatttcaaagaagcattcggaagccattatctatttgagttatcttttcattcaaaatcatcaactattataatttgctgatatcaatgaataagacaccaat

SEQ ID NO: 2562 - DNA, 975 bp, Rubella virus
  capsid protein, E1 and E2 envelope proteins, complete1
tccgcatttccgcgcgatccagaagatcatcatgcgcccctgcgcccgcaattccttgtggccgctggccatacggagcccgaggtcgacgcctggtggcaggctcattacaccaccaacgccatcgaggtcgacttcactgagttcgacatgaaccagacccttgctactcgggacgtcgagctcgagatcagcgccgctctcttgggcctcccttgcgccgaagactaccgcgcgctccgcgccggcagctattgcactctgcgcgaactgggctccactgagaccggctgcgagcgcacaagcggcgagcccgccacgctactgcacaacaccaccgtggccatgtgcatggctatgcgcatggtccccaaaggcgtgcgctgggccgggattttccagggcgacgatatggtcatcttcctccccgagggcgcgcgcaatgcggcactcaagtggacccccgccgaggtgggcttgttcggcttccacatcccagtgaagcatgtgagcaccccaacccccagcttctgcgggcacgtcggcaccgcggccggcctcttccatgatgtcatgcaccaggcaatcaaggtgctttgccgccgtttcgaccccgacgtgcttgaagaacagcaggtggccctcctcgaccgcctccggggggtctacgcggctctgcctgacaccgttgcgccaatgctgcgtactatgactacagcgcggagcgcgtcctcgctatcgtgcgcgaacttaccgcgtacgcgggggcgcggcctcgaccacccggccaccatcggcgcgctcgaggagattcagactccctacgcgcgcgccaatctccacgacgctgactaacgcccccgtacgtggggcctttaatctcatctactctaaccaggtcatcacccaccgttgtttcgccgcatctggtgggtaccccactcttgccattcgggagagccccagggtgcccga

SEQ ID NO: 2563 - DNA, 976 bp, Euscelidius variegatus virus 1
  isolate to-1, complete genome.1
tggactcgtattttgacctcagccgatttgctgtttgagctagatctgatagaaatgcaagataactggcgtctcgactgttgtagtcaaatgtgttgctagatctgaaagaaatgtaaccttttgatctttagttttaaggaattttaataaacttaaataaactattgcgaacgatctccaagaagtaattttttgtaaagttttgtgtcttgttgaagccgaagcgaagtagtaacgaaagtgaagcgcggacgaagcagtatatcaagcacatgttttaaaattcaaaattaacatatagtcacgacctatttcttcgtgtatccattgtgcatatggagaaataattgttgcatatagtcacagtctatcactctgtgtatcctggtttgtatttgcctcaggagaaataattgttaccaaatacatcccaaaaaggggttaaagtttatccctggccatttgccttaaactgattctcgtgcgtgtcacaatttggtcaccgagatgatgtaaaactcttcacaataaccttttgtagcaatggaagttgtgtaagtattatgagtagctacctaggttttgcaagtgcgtggaataactcgtcatcttttagtgaagaactctgcaccgtaggaatcccttactgatatcttagcgctgataggcttttgtttacggacaaagtcgacagttaagatatgggctgggcagaacttaagagtaggcctgagaaacctgctctgagttgcggctcctgtacgatattcatttgatgacttgtgtttctataatcgcaaacacttagacgtcccccgcgcggtaccggctggacgaagaagtacctttatggtaggccgttctcccgtcgaacgacgggatcaaacacccaactaggtcctgtgtctcgccgttctcgtcttctcggcgactcactttcatctcaatttctttttctctatattttttcaaa

SEQ ID NO: 2564 - DNA, 982 bp, Wuhan pillworm virus 1
  strain WHSFII20185 putative glycoprotein1
gccccccccaagatactcacccaagtgtttaacaatcttgcttgaactgactacctacaaaaccggctgctacagtgactgtaacagtgtgtgagacataaagtcttaattactcactcttgccttaatcactgttatcaaagtggatttgacattctatataatcctgttttacgcagtattaatagccatcacatttgctctgttatactgctatatgaagtgattatgggccacaattcaggagtatagggtgtcaccaaacactattggacaccaatgtctggttgcttggatttaagttcagcactagaactggtatctgtgagggaatttgctgagaggattaataaggaggagtcaaaccttcaatcctttgtgagactattttattatttgaggaacaaagggttgactagtgaattggagaacgaatatagtagtatagtgaaaaggattgatgtgctgaggcctatacaagttctaggagaaggattaaactgttatacactaaatcaagaagtattatctaaatttgtcgtaagattgactattcattcagtggtgagtgatactggcttcagtagtaacagagtgaaggtagtttgtaagggaggaaagacagaaaaggtaaccggtatacaagctgtcagaaaagtactggaaccttgctataagaggagtagattgctagatagactcagcagaggctgtgaagcagttgtactttgtcagaagtggtttgtgacacttaaggtcattaaaagaggtagtatcagtaaactgcactgcctttgtagggatataaacatcacattgaataagaagcagctgagcttcttaggtatttataaggcaggttacgactacttctgtggggaattaaacttcttcctaactctgctagattatattagtggaggtagttttgatagaggcagtaacagcacacacataaaagaattgttgggtaaactaagtg

SEQ ID NO: 2565 - DNA, 983 bp, Hubei coleoptera virus 1
  strain QCM131202 hypothetical protein1
tgcatacgtacatatttgaacatattttaacgtaatagtgtgaatgtttctttatattatgtttactctctttaagtatgatagtgttattaatgtattgagtggactataaaaatcagtgttatattaatttttggtatgaatataacacgtttatttgcgtatggattttgcgtccatatgaatgattttaagagaggctattgagttttatatattacggttttgatgttcaatgacaatgggaaagactataaatttcgttttagattttataattaatgtgtgaatgtggtagttcaagggattttatactcctgaatagtaacaaaattataaaataaacaaaaatattatgttagatttagttagtacctagacgatttaatattagtaagatgaacggtacgttaagattaagtttttacataagaacaagcttaattattatatgcttatcccagtgagagtatattctttgagatgtattatacataaaataagtgcagacagtgtaacaaaaatccagttatgctgcgttataagcaagttggtaccagatgactttataactttctggcacgaaggattattccccgacttcgtggtccccttattctatgtatgatttcatttttttgaggtatatttcttgcgtaggatttttaattctgagggtaagtacgctgctaagtaatcagaacgtattattgatcctgtgggaaagctagactggatcagagaacaatagcctttaatgttcttgaatgtatgtatttgttccagtataatttgtaggcaggcttgttacgttcgcagaggagtctttagtttaatgtaatttacatataaatcctcagacggtgacggatggaaagacatcattttccttttttatgcagattttatattgatttttcttgtttgtcgaagttattctcagtgttttatccctttaacgtttttctttaatattttgtata

SEQ ID NO: 2566 - DNA, 984 bp, Southern bean mosaic virus
  clone contig608 polyprotein P2ab and1
agaggcacttagaattagttgctttgtgtgttaccgagagattgttcttactcagtgaagctgaggatctacacaataaatcccctgtggacctagttcagatggggttgtgtgacccagttcggctgtttgtcaagcaggagccccatgcttcccgaaaggtgaaggagggtagatttcgcttgatttcatccgtttcgctggtggatcagcttgtagagcgaatgcttttcgggccccaaaaccagcttgagatcgctgagtgggaacatattccctcaaaacctggtatgggcctttcgctgcaacgacaagccaaaagcttgttcgacgatttgagagtcaaacattctcgttgtcctgcggctgaggccgacatatcgggttttgactggtctgttcaagactgggagttgtgggctgatgtagagatgagaatagttttaggaggttttggacagaagttgtccatagccgctagaaacaggttttcgtgcttcatgaactcagtcttccagctctcggatggcacgcttatagaacagcaactgcctggtattatgaagtctggttcttactgcacttcctcgacaaactccagaatacgttgccttatggctgaacttattggttccccatggtgtatagccatgggtgatgattctgttgagggttgggttgatggtgcgaaggacaagtacatgagattaggccacacgtgcaaggattataaaccctgtgcaacatccatttccggtcgcttatacgaggtagagttttgctctcacgttataagggaagatcgatgttggttggcgtcgtggcccaaaactctgtataaatacttgtctgagggcaagtggttctttgaggaccttgagcgagagcttgggtcttctccccactggcctagaatcagacactatgtagtcgggaatactccatcgcccgacaaaactagattagaaaatttaagtccgagct

SEQ ID NO: 2567 - DNA, 985 bp, Barns Ness breadcrumb sponge weivirus-like virus 1
  isolate V92,1
actgccagacagatgaattcaccgtgccaccgtgcacggttgctctgaatttgtagggagcgtcgggggaggaaatgcccctggcggagatgacgctgtgcacacaacgcgactactgatctaagcatcagtgagtccgggggattcttaccgtctcgtccgagcttgtgcactgaagggggccgcacccctagtcagccttgttcttctgccacacttttcactgtgagtgtggtgagagcctgtagtggcgtactaagctctgcgcctgaggtgaaggcctctgggaaactggatttaacccccggttgggactggcctcccttaattcccatacccgagacggacaatgcggtaggcacctcttgatgccccacaccagatgtgagtcggcctttttggacttgcacaggtggatgtagggaacgaggagaagtcgaagctggtcaccaagcagtaatgcgtggtgtgttggctatccgtccagtgttgattggttacggtaccgtggcccggcgtttttccgggtgatgctatcgagcatgtggttagagctccgacagaatgaggaaccggtcaccgaccactgttgagccgcagggaacccttctgttccggcttgtttgacccacgtgattagagaaacatcggtttgtatagaaatcagtgacgatgcatgcatccgaagccccaaataaataaaatatagcggcttctgtgtacagtgcaggcttggtccatccccacatgaactccttcgtggttaagcgacattcgatgcgttcggaaactgcttctgcgcggggtatgattgtgtgggggtggccagactttgcccagggttggacgtctatcacgtggttaagcgacttccgatgcgttcggtcactgcttctgcgtggttatgcccgttctgacgctgccaagcgactcccgcttgagacgtgtatagttttttcggccttgccgtctgtttatctgagtg

SEQ ID NO: 2568 - DNA, 987 bp, Chaetoceros tenuissimus
  RNA virus type-II DNA, nearly complete1
catggacgtaatgtccatgcagagaattataatacttttatcagatatatctatgatattgtttcaagagttcatcttgaaactttcgtatgttagagcttgtatattgttgtcaatgtatgggttcttcccatacaacttcatatacaagatatttttcatacgctaagtttcgtaattgatagaatctcttgttgctttaagtagaatatttgatgaggtgttattattcgccccagttttctatctgtttacagctacgacttaaccattagtcgataacgcaggctgtatcctagttcagtaaagtacatagaatgcaaagatatttagactacttaagctactgataaagtttatactttcgcttttgatgtagatgttcatttacttaagtatagcgctctgaaccgagcgcttttgtttatgaaagaatttaatcaactctttcacccggccacacatctttagagatgtttatgacagtattaatttgtttaatactcgaggccaaatttcggtgtttttactaattgcaagatgtctacggactgccaaaatcttgtgtatttagtataaattcctctcccattttagttttaactatgaaattcttttattagttgactatttaggtttaggactttaacactgctcgaggaatccccctttatatgtgaaaattgcgatttaacacatactcgccccaaagaagggtttagagatgttagtaaaagaataacattttagagaagaatcggtccttggaggtgttttaatggaacgtaccccaagatcttattataaccggaatatacaaaggatgtatgtataatttaaggtatagttaccgctatgctagggccgacatgcccgatttttaattacctctacccgatgttgaccagtcaatatttttaaactaatgaattagttttattctaactttggaggaaagttatttggcacgccctttctattttaatc

SEQ ID NO: 2569 - DNA, 988 bp, Marine RNA virus SF-1
  RNA-dependent RNA polymerase and structural1
aaaataatgcatgaaatatagattttatctatatttcatgccacatttgtgacccttgagaaggtcataccgcattatgcggttctaagttaataactcacttcagtccagaagactgttaagtagttctgacggtggaaagccgtcatctgttacattattagttataataggatgtgtactcctaactagacgatctctacccttaagtcggaagccagcgtttagtgctgagtgcttccgtcacctttggatgacaaatcgtctacttcgactcattaatccgaaagttacctaattttcgtaacccctgtgtctgtgttcagtaaatgacagacagtttgagataaactaaaaatctcccaagtctccacaagtgacatcaatgatctgaactttatttttgacgtttgagatggtgaatgaaggccttgtgcctgtcctcactcttctttaatctttagtaagtcagtgactaacttgtgttatcctagttgattatactaggcttatcgttttctacaaaattttgatgcaaaatcggaacgaatttattcgtaacccgtgagcgtttcaaggtctttgcccttgatcctaaattttttgctatatttcgtgtcgtatcaagtcattttattaatactttttgacttgcctgaacgatgatgtctcgtttgggaagctgcgtaagcagttaactaacaaggtataccagaggatgtaatccccttccagttaccccttgtgttttgaagtactttttcgtaacttcgtgacattcgacctggttctaactcagatgtttgataaactttcgaactatcactgtgaaaggtgctttagcaccttacttgaacccgtcgtctaacacggacatcgttaacgtatgtagaatactatgagagatgttaaattcctcttattgaccacattggaaggcccttagaaaaggcccacactatagactggtgtctaagtccatcccgcc

SEQ ID NO: 2570 - DNA, 989 bp, Sclerotium rolfsii mycovirus dsRNA 1
  strain BLH-1-16 hypothetical2
ggcccgatagttaccaagcgcgcggtaatagactttaccgcttcagcaattcacgggtgcctacccctagtgtggatgaaggtgctcgcatttataatatagtacataaatatttgcctaaccacaaagttttaactggaggtcttccttcaagtagacgagctggtctcgattatttattgccacctgccctgaggagcggcaacgaaacggctggtccgttggcaggtagtacgctggacgtacgtgctcgaggcggtcctcgactcacggtcacgaagactgaggtcggtgttactgaggtaggagaaaatgttcacggtcccaagaatgaggatagagccctgtccccgcatgagactattacacgttctctttccggtgtttcgctgatcggaagtagtcgtggtagtgatgacggttctgcttcgtccccacggccgggtggtgttaccacctgccaacccccctcccctactggattatcgaggcaggcagtcaaagataactatgtgggcggtgtcgatgaaactacccaagctgcggatgtgacatcggcacgtatcggcaagcaagctgtgacaccggaagtatctgataacgaacaacctccaagtggtatcagatgggaacccttacgcagacaaggggcaaagttcgtcctgctcatcccgagtggagaaggtaaaacatatttggccgagacgtatcctgagatcttcaccgatcacgatgccctcgaggattacacaattgaggtccaaccgtacattgagcaggcacgcgaaagtggcgactggtcatacatcgatgcggtccaccgccggagtagcgccaagtgccaaacacctgtactactatcgtggaacgtttcgacatacgatcatacccgcttcgtgagtctaggtgcgtatttattgcgccaacctactaacattcgtgaaaacgagaataaccgtgccgctctgatcgcaacccacgattattgt

SEQ ID NO: 2571 - DNA, 992 bp, Wuhan japanese halfbeak arterivirus
  strain DSYS15584 1A, 1b1
ctgaaaagcatcccctaaacttcagttaaacgctgattccgagaaagaaataccctgctttctcagctacaaaatctgtctggctcatagtgctggttaatcacatcccccgtggtgtaacactgtgacacatacaatttgtagtccctctccttactctacccccgagtgtctcttatcggttactcaaaagttgtgtttggtttgtccgcttttcggattttgtgttagaattacattataaccttatcctagtttgtgttgtgattatatgtaaaaactcttcgtgtgaaagtttgaaattttgtgtgttcttattgtacctctttaacccacatatataatttctggcctcttgccttacctgtaggatttccaaagcctaaagtataatctccccgctagaggtctgttgtgtgaatcagaccattctttaacgtaaagtcacccgtatcgacgctaccatcacacagtaggatcaagattagctccggcagccctggggcgtcttctttgatacaacatcacctttgctggtgcttgcaccgcttgggtatatttttcggtacttgcaccttcgggtgttgtggcctcttactagtttttctcccccttacgtaccttcgccccttgggcccggagtccctgtaattggcatcgcaattgtggtgtcaccctaggcactgcctttattggttctgtctaggtcggtgtggtaagggtagaaaggcgataaacaccgtacattgtttattctattttatagctttcgctactgacttctatgactgattccctcctgtacttagcctcccacccggcggcacttgtcactcttacggctgtggttcttttcctttacctgtatgctggttgtcgtgcattgtttttagacggtgtgaagttagctagatattgtggaactcctctttgttggggtgttaagtgtctctgttgttttgttagaagaggtaagtcacctcgccaagaag

SEQ ID NO: 2572 - DNA, 994 bp, Sclerotium rolfsii hypovirus 8
  strain BLH-1-3 polyprotein gene,1
tataggtgctgtaggtctccccgtcgctcaccattacggtgttagcgtacgagctcgtgcgttgtatgcacgagtaccctacagacttcttaggtcttgtcgaccctgctggttgcgccgtcgtcgttagacggactctattcggacgtcatttgttttcgtccaaccccccttccaaaagactgcgtggagcggtcaatctagttacgggctgacagtagtggtgctgtcactaaggaacaccaggctggcctcagaggaaaagctgagtaataacaaacccgttaagtgatcacatagcctcgctagcatgtgacacagcgctatgactctgatgcgtcaggatgcactagcatcccaggaaagagtacgtgagacaatatgaacacagtgcgtgacctttgttcacctgtgcgattttggctccctagctgtatgccgcagcgacttgtcttgggttgatgtcgaataacccacgtagaatcttatccgaaacctctccacacacaaccgtcgacgcagcgacgttaaatacccggctatgcggaagtaccgaaagtcgggcgggcgtcaaatctacgccttaaggtcaaccaaaactttgcaattgcatcgtgtgtcagatgacacgaccatgagtcctcctggacacttctctagcttgctagagttgcccgccaccacagctgttataggcccttcggggatggtgcgactagtgttagcacccgtgtgaaagagagggcgcgttacgccctataaacgcttgttaggatagctttcccctggagaggagggactagtgtcgatgaaaacctcacaactcgaaagagtattgaagagcctcggcgcgtcaatcttaaaccaaacacccagtgccatttaaaacccgaaaagggtggatggtataaccaaagttctcaaaaggagccactgtgtggagtgcgacgtatagttcaccaggtcagccatagggttgtttacaaaacaacaa

SEQ ID NO: 2573 - DNA, 1000 bp, Agaricus bisporus virus 2
  strain C19-C23-C1, isolate AbV2-003,1
tcattccacagtggagtgtttgctgacggtgagttaaaatttttgcctctattcttcttcgcgaagtgtgttgatggtagcatatgcatccattattaaagacaagctgtgccgggtgtttcgttatatgtggacacgaagcgggtaatcctgtggaaaccacccccatcagaagtagcaccaaccggttatcgtggccgatttggtagttagtacctcgcggtagggcttcggcccgcgtaagacactagcattaggcagcgcagagacagtcagaaccatggaggccgtaatagccgttgaagtgtgatgatcctccagtgctcgggcgacgtgcagtacctaggcgaacgcgcgtaaatcttttgaaataagggtataagtgatatgacgaggcgggtagcttgacaaccacctagataagtcgaagaatatggaagaaggacgagaacgagtaagaaaatagaaaagcccaactttggcaagtttgtagaggatggggtgttttaggtcacaaatatggagtagggagcttcggcgaacctgcaaaacctacacatagtgctataagcgctgcccagcgtgaaaggccgtgatcataaccgtacgagggggcatcgagactggacctgtcgttacagcaagggtagacatttggggaaaccggcgatgctcatcgggtgtcgtgtcgctcctacctaaacttagagatgttaagttctggcggggggtcaacctatgtcgtgtcatttcgggtcaatttcactcattggaagtggaatccgctaacagagcatgcacggacgacgtctgtggtcaagcaacctttgtttgggaagaatcctgttatacaacttctacggttccttcgtctctacgaaccaatcgaagtctactgtttacctatctcgatgttactttacgacacacctccacgtgatcagtccgtcaagttaggtcacccatggtgaaaggcgatgtatgctaagaactcgaagcc

SEQ ID NO: 2574 - DNA, 1000 bp, Agaricus bisporus virus 2
  strain C19-C1, isolate AbV2-003, partial1
ggcagcgcagagacagtcagaaccatggaggccgtaatagccgttgaagtgtgatgatcctccagtgctcgggcgacgtgcagtacctaggcgaacgcgcgtaaatcttttgaaataagggtataagtgatatgacgaggcgggtagcttgacaaccacctagataagtcgaagaatatggaagaaggacgagaacgagtaagaaaatagaaaagcccaactttggcaagtttgtagaggatggggtgttttaggtcacaaatatggagtagggagcttcggcgaacctgcaaaacctacacatagtgctataagcgctgcccagcgtgaaaggccgtgatcataaccgtacgagggggcatcgagactggacctgtcgttacagcaagggtagacatttggggaaaccggcgatgctcatcgggtgtcgtgtcgctcctacctaaacttagagatgttaagttctggcggggggtcaacctatgtcgtgtcatttcgggtcaatttcactcattggaagtggaatccgctaacagagcatgcacggacgacgtctgtggtcaagcaacctttgtttgggaagaatcctgttatacaacttctacggttccttcgtctctacgaaccaatcgaagtctactgtttacctatctcgatgttactttacgacacacctccacgtgatcagtccgtcaagttaggtcacccatggtgaaaggcgatgtatgctaagaactcgaagccttggttgattgggccgctaccctctggggtccgtgcacggtctatttagccttggttaggggacaaccctgcagcaaactcaccctctggagaatcctttctttatgtatgaattacgcggatacaaaatctacaaaactacctaaagggccttgcaagcgggaaagccaaaaacgtcgatttcgaggcactcgaacggagagttgggaacagcgtgatctacttctcgactcccgtcgtcgaagtcggcgtgact

SEQ ID NO: 2575 - DNA, 1000 bp, Grapevine leafroll-associated virus Carn
  isolate Carnelian1
ctaaatcgcttcaaactgatggtgaagggtgatgtgaagtttaagggcgactcagaagcgttggaggagtttgctccgggacaaaacattgttttccacagccgactagtttgtgcgcacttcgcaagcgtattttgtgagctagtgaacaggttacgctcaatatgtgctccaaacgtaatattattcaatggcctatccttcgaagactttgcggcacacgtggactcatgtttggatggtgaacccctctataatttcaagagtgacgaaatagacatttcaaaatacgacaagtctcaaagcactttaaccaaagccatagagcttgaggtttacaggagattgggactggatcaacgcattcttgatgtgtggggatcgtcagagttttatggtagagcaaccacgggttcaagaagcttctctgcggagatattcgctcagaggcgtactggtgccgccaacacctggataggtaacacgattataaatatgtgtttattggcccagagcacagacccgagactctttaaggtggcgtgttttgctggagacgatagtctactaatctatcgaaagaaacccaccatacactttgagtactatgagacaaagttcgacttcgacgtgaagtattacgactctgcggcaatgtacttctgtggaaagtttcttatctcagatggggagaaaactcgaattgttccagaccccatgaaactttttgtgaaattgggaaaagagcggccctgtcatgattctgtattgttggagaattggaggtcattttttgacgtcacgaaagcgtatgcaaataacaccgttttggaacgtttggtggagcaatttgcattgaaatatacagaatcaccacaggcttatgcagccttttgtgcagtgaactcaatcagaagcaatccagaacaattcaagagattgtggttttctttgtatagtgggttttcgagcgacatcaagcaaagattgaggtgacttc

SEQ ID NO: 2576 - DNA, 1000 bp, Pterostylis sanguinea virus A
  isolate Murdoch-7 coat protein gene,1
tggtggggggttgggaaaaaataatccaaccccacagttgacaaaccaagcacagcgcaagaccaacaaggaaaattagtgggttattgtaagtgaacccaatcgagtatattgatcgagcgaacgaacaagatgtgatgtggcaaggcgtgtcgatgtttctaccatcctctgaattatagctgtgtgcggagtaattatgatggagctaagtcgtgcacttcccttgtgtggttgactggtggccgaggcgatttatttcgtgggcggtacagttaacctagtggtaatgcagcacggtagaccttttagtacataagttgccgtccggtcctaagcccgggtacatgcagaaggacacgcgttaagctgtaacgcgggttatgtcacagcagactccgacagaatctgcagccatccttcggcccccaatgcgcgggcagatgagtgtgatggatgcgggacactaacggaggttccgggtaatgggtgaaaccgagccgacgcgaaagcgacaggccccccggacatagggagcccactgaccctgaccgccaacacaaaggatgttggccagggaggagtggtaaactatgggtagtgacaacatactagagcaaggtatgttgattgcaagacgcggacggctatttaggggcgaaccctatctaaaacagtctagtgtaaccccatgcaacatgggcgcgctagctgggcaacgggaagggtggttctggaccgtagttcgtcgacatctgacagggcaagccccttgagatgtacacgaggctcgagaggacagaggcgcgcgtcggtctccctgacaaggaggcttaaggtgtaaacagcgtgtttgggagttagtggatattgaattctgtggatgcttacatcgcctaggtattaaattacggacgatggaagtgttcacaaagttccttataccctgcggccacggtcattgaccctaagcccgagctcccttcatgactgacattcg

SEQ ID NO: 2577 - DNA, 1000 bp, Haemorrhagic kidney syndrome virus
  capsid protein gene, complete1
ctcttgacgccagagttgctagtctccgtggtacatccaagaagcactctggggagccaggcaccatgcttttcaacactatttggaacatgaccgctgttttccacaccaccagtttcactagaatgaccctctagctcttcaaaggagatgactccgttgtgtgctgtgactccagcatgcccaccccaattgctaaggagttcatctctcagaacgggctcgtcatgaaacagaagacgtcccacctcggctccttcacatgcagtctcgtcacccgcacaagttatgtcccggacgtctacaggttcgcttgcaggctgaacaacaacgacttcacagataccaagcgcatcgaggatctccagagggccacagacgatttcatcaagagagcgactgtcaccaccaactacgggttccacttgctcgatcaacggcagatactacgtgtccttcggacaccattgagtgtgtcgttggcttcctccaagattttgctctcaccggaaaaatagacctccaaacatcatacaaaccaattttaaaatattaaaataagagaagaaattaaataagttggacattagttatgtgcgcttgagatagatacagtcactatggcagattccaaagcagtcgctccttccgtacaatctaaaccacgtcgcactaggcgtccaaagatggacccttctcagatcccagatacagtcaaaaccttccgtctcacaaccgaccctattatggcacctccacctggtgaagttgattcacttctctacacatcaggcctttcacctgcagttgtcctttccttctccccattcacctcccccgcagttgtcttcgccgccaactatgagaatacaagatcttatctttcaaagctactgtcctctccctagcaccagaagctatttccagttacaacctctctgtcgtctggttcccagatgcatcagaagggcccacctctcttcaagctacaaacttgtcc

SEQ ID NO: 2578 - DNA, 1000 bp, Xinjiang tick associated virus 1
  strain 16-T2 ORF2 gene, complete1
cccgtgcgggtttttctggtgctccttatgcaatgggcaacaaggtttacggtatgcatctgggtgcttcctctgaaaacataggctacgatgctggctacattctcatgaagttgaggggtttgaccgagtcatcaactgactatttcgagaaactcgtggacaacgctagacgccgcgggcgcaagcttgtggtgcgaaacactggtgatcctgacgttgttgaagttttcgtcaagggtcactacgtgcgtcttgaccgcgatctcttggaaggttatggggatgaggttgagtcagccacttactctcaggagagtgttagtcagggaaacggaaaggggccccgtgcggatgcgcggggccctgggcagaagacctctccggtccctgctcccgtcccgagtgggcaaagttctcccttaaccccgaaacagccgcaagctgcgacggaggagaagggtacggagtcccccgcatcgacgcctgtgccatcaagcagtcgttcgccaaccacgtccgcatccgtgaagcccaaggctctgctcgaccagcagggacgattgtcgaaagatgtcttgactgtcttgagcaaactttcggcgaatggaggttccggcctcaactcggccgaattgaaattgctaaggcaatacgcgaactcgactttacctcaacacccggttattgtcagttcagtggctacggcccaaccaacggtgccatcttaggatgggacgggttggactttaagcgtcgggatgtctatgaggcacttgtctctgcggtggagtatcgacttgggcaactcacacaaggaaaactagtctatgatcccatcaagcttttcatcaagcaggagccgcacaaacgggctaagctggaggaaggccggttgcgacttatttctgccatctctttggtggatcaggtcgttgaccgagtgttgtttggccgattggtggagagggttctctccactgttggccgaacaccttgc

SEQ ID NO: 2579 - DNA, 1000 bp, Trichoderma asperellum dsRNA virus 1
  isolate JLM45-3 hypothetical1
gtttctaatataatgcaaaccccgtaagttacgatgactggctcggccgttgtaactgagtatgttgttgaggtgagtgtaatgagcaggaccgcccggagaggatagtatttatccctcattgtagcttccaggatcacgaacgttagtctaagtattgacggttacttgcagtatttagttctggccggaatgacacacatggaccgtcctttatgtggacggagggcgttacctctaaacctagactctgcgctgcgagtcaggatgaggatgctacttcaatgtatcttcagcctgacactactgcagtgtcgggtctaggtttaaattgagccaccttagtgggtttcaccagtatgaaagaatatactggcacccgtgcaggcaccgtttcccttgggctgggagaaaaacgcatccggttcgaaacaccctaattggttaggcttctgcctttccggccactcatccgtcattgagttctattatgtttccttccctcgtagaagccgggggcacatcatgtggcaacgaaactaggcctccgtagcaatctcacggttaagatgattatcgcgcggctgaaaatagggacggggcgccgtacccgcgcattactgttaggcgtctaggcaaatattgggatagaccccagtagtttccacgcgcggtagggctggccgctaaatataaaacacagtcaaagtcatcgcggatagtggcctaaccagccgctagacctgctcaagggttccggaattcgcaagttttctgggtgtgctgtgtagtagctggacagagtagctgcacggtgctaacgtatgcttaggctgtccgccctaagtagaacgtgccgaaaggtggtctatcgtacgtaacgaaggagggacgtactgggtttaatcccgaggtagggagcgcctgtaggtggaacgactgcccctgagttgaatgcacggttgtgcacgcggaacagtctgctgggcatcccccagtg

SEQ ID NO: 2580 - DNA, 1000 bp, Fusarium poae dsRNA virus 2
  isolate SX63, complete genome.1
gcccgtgaacaccccctgtcttcctcactgggacgatcccaccagtataaaaataggtccgtctggctgcatgttaaacagcccaggtcagcgctgtcacgctgggtttatcacctaacaatacgacccctcgcatcacgtcgtaaaactgtgagagctcgtccattgctggcgacgaattaaacagcgtactgcaggcatggggtgtttaaaaggtaggttgcttaggctgtatgttgccgatatgatacagaaacccttcgcgctgatcaaaccactgggctcaaacaaaccagtggatgctgcagtcggtcaaattcacttcgttgaagtgcttcgggtaactcccgaatcatgaggtaactagtggaccgtcaacccctcatttactaccacacttgggacttttgagagcttccttgtgtggatatgttataaaatgagtgttggttcggcgtttgcgcgtcgaatttctaagattaacacctggtgcgcactcctccggcttcggccgggggtgtgcgtagcaggagtttgttttagaaatgcacttattcaattaactcaagtcctaggtatgacttaaaactacctccccccgccctaggtatggcataaaactaccttccttggcaccgtgaagtgtttaaactagcaacctcggtggcgtgggtagatatgctcagccactataagcgtctcgggcgtgacggttattactcaaaaatcgccaaaatccatcgtgtgagcgggagatgaccctgccggacgggaggtaacctagatgtcaactagggtgtgaccacaatgcggccaacgttgtgcgagctatcgtaaccagggacggtctggatgtagcgtacgggtgcaatctctaatgcaccacttctgttgctacccctggggaacgagccatgcttaggtatggtggacagactgacactcctgtcgctaagtttcatagcgcaccaaacagtcggctgggtctacgggcccagtg

SEQ ID NO: 2581 - DNA, 1000 bp, Fusarium poae dsRNA virus 3
  isolate SX63, complete genome.1
aaatctcggacggtgccgcgcgatcctaggcacttttgttcggggcgttgtatctcactcagcgtcctcctcagccctgagaccatagggttatccgacgacttggctataaatataacatcctccctttagtggaatcgcccttacaccaacttagggccttttccagggaaaggaacccgtgccgccgcgcaattcgcggtttaccatggtgcggggttgtcggagtaggtacgtgtgctagcggtagagagtatatgatgcggtttttcgctgatttcctactgagcaccctacgcccgaatttttaggaagaacggccctcaaaaacgagaaagctgttctgccccgaaaatttgaggggtaccaccatttacgtccagcatgacggaaaaaggcataccaaactctggtcactcgcgccctgggcacggcggtaaactgcaccatttgcgtgatctatatggtcgaaatagtcgcacacctcgttaaacctcctactgcacagctctattgatcgagaaccctttagtgggaatgcagagctcacactcggcgtgtggtcaggataggtgaggttggcttccgtttcagcgcatcctgtggtgagccccacacacataagctcaaaaaccagagtcctgccgcctaatacgcgggatataaaggaagcggaggggtcattcgctataataaaattagatcaaaagcatcgcggatagtgggctcaccacccattagacctgctgtagggttccgattcggagtaatccgatagggtgtgctggtagctagctggttagagtaggctatcggtgctaacgtatgcttgggctaaccgacccaggtagaacgtgccgaaaggtggtctctgcgcaagcccgaaggcgcggtttgctaggtttaatccaagcggagggagcgcccgtaggtggaacgactgccccacagttgacgcaaggttttgcacgcggaccagtctgccggacaacctccggtg

SEQ ID NO: 2582 - DNA, 1000 bp, Fusarium virguliforme dsRNA mycovirus 1
  putative structural/gag1
agttatcagtctctcatgttcgtagcgagtacatgagtatcacagctgaccaggtggcaggctaagaggaattcgagggtaaaagcagggtatccaacttcacccatcaagcaactatcttcgtgttcatttctccatcgtgctaaggcgacggtgtgtcatctctaattcttgattgtggtagcgattgtgctaaccatacaagataaaagccctcagttataaaccctgcagcctattacgtacatagccaggggcgctaactttaaattgagcgctgtaactgtagcctgtcaggatgggagcagagtctatatggcggtagtcgtcgtgatctgcgcatagccaacctctgtacatctctattgtgtcgcaacccttcagtgggaacggagagatcgcagcgaccgtgcggagcgtctggtgtggtgaccttcttctacaactatttccatctgtctcgaggaaagccgggacgtcagtaaactaggcccacgcatcaaaggcgtctaacatgaggctactaatgacaaaggcttaatcattagattcgacacgctgcccggccgtgcagccgctgtattcataaatcggcaatcgcttcgtctagtgggaactaaccattcctacgtccggtgtgagggttctccttttggaggtgtccacttcagatatcgcacaggagtttctgatttgggctaacgtatgcgtgtagctgtgcgtctacaagtagaacgtgccgaacggtggtctctgcagtgtctcgaaggcgcagatacttaggatagaatccaagcggagggagcgcctattaggtggaacgactgcccccatttccgatgtacggttgtacagacggaccagtctatcgggcatacccggtgaagcgaattcatatcatctagtggtgtccttaattaacggcgtcactttaatcccaaaaattgttgattagtgaaatttaagttagaagcttattttacgactctcttcacccacc

SEQ ID NO: 2583 - DNA, 1000 bp, Macrophomina phaseolina double-stranded RNA virus 2
  isolate Mp31
aaatatgcacgccccctccctgaagcttaatagtagtgatacccttggacctgtccagggccgcacgctgggcccgaagtagtcttcctgaaggcttaagagtttaggactcacagccgaggtaggtgactgggcttcaacacctctatggttcttttccctcctttggcacaggggggaactgattaaatagaggcatagcggtgacaatcgctatataaatatgacctactcgtagggccgcgagtataaataaggcttgccaagagcatcgcgtattcaggattaccagacctgaagtcctctgtcggggttccgtccctagtcatgctgcatgggttgccatgcggtaggctagcacacgggtgtgtttctaactggctatgcagagtaggttagaaatgctaacgtatgcttaggctgcatgtcctaagtagaacgtgccgaagggtggtctctggggcgagatggtgtcagctgctgggctatgtaaatccggggtgtcttagcttaaccagtatgcgggcgtgtgtagggtagtggcttgtaagtccgggggtagtcgtccaactaacagtgtcggctacatgcttagccttaagctaccttgcatacatctcttaaccggagggagcgccttagtaggtggaacgactgcccctgacggtgacgcttggtagcgacgcggaccagtctgcccggcaccaccgggtgatgctcttatgccatatcgccgagagataacgaacggcgctagcccctagatccgggctggctttctctccgcatatgctagggtggccagacgtcccttgactggtactcacttccgggccgcggcggcctttgtcacttctttgtccttccacggatgccagccccgttcaccacatcctcatcccctaggaaacttggggaaagtagccggtgtatagcaactctcaaggggtagtgggaggagatcggaaaaatcgagtcataaaagcctgcacgaaacatt

SEQ ID NO: 2584 - DNA, 1000 bp, Sclerotinia sclerotiorum
  dsRNA mycovirus-L,isolate Sunf-M, complete1
ttgggcgcgaatccagctagtgtagtagggggcaggaaagaacgaagtacgtgttaactatatgattcatccaacttgggtcatatacagcgtattgctacccaaggtgtcaaggtagtgtgtgcgatttacaacagcagcactactaaaaaacatcacagaccttggggcctactacagagagtacaaccgttagggtaggtaagggcaggagctacaacctcttgatctcttaccaggccagcggctctcagcccctgttttatatttactcctccccggtctagcggtgggggagtggtataaaatgagcggtcgcgctcacttgaattaatcttttacgtttacgcgcataaaatcaggacacatctcttgtatactttagtatatcaatgatgtttttgttttatgcgattaatcgtaagagaacttctttccatccgcctgtatgggcgggataataagttcaccgccttggtcgaggcgcaaacttgtatgtgcaaaggtgagctatatgctcgaaatagtcgtaactaacacacagccactacctgtagagctctattgatccggaatcctttagtgggaatgcagagctcacaccggacctgcgggtatcttcggcgttagggacttctgtttcagccttgaatcatttacctttataccttctctgaggcgcctgggccgggcgcgatattaagtacaagtcaaggacatcgcgggtagtggtctaatcagccgctagtcctgctggagagttccaacttagttgggtgtggtgcatactagctggatagagtaggtatgtattgctaacgtatgccggaggctatccgtcctcggtagaacgtgccgaggagtagtctctgcagacccccgaacgcgtggggtctttacttaaatgtaggcggagggagcgctcgtaggtggaacgactgcctcccagtcgaatgcaagattttgcacgcggaccagtctgcccggcaattcccgggtg

SEQ ID NO: 2585 - DNA, 1000 bp, Bremia lactucae associated fusagravirus 3
  isolate DML-A_DN432831
gcactaaattgataagtgaggtccgcaaatttgcagctacgccagcaatggcgtatgctgaacagcctcccgtcctggtgcgacctaaccaggggagttacaaattgccagatggcaagactgtgcgcagagcgcgggtcgtgtcgtctggtggtaacgccactcggaacagtgaggtttcgagaacttccggcccccgtcggaacgttaaaggtgcagtgatcgggggttccggtggagggggatcgtcctttcgcgcgggtgtggggaaggagagtggttctcacacggacgtgcagggtatcgtaagcggcgcgcttacgatggccaagcacccaagagtgatggcgaagtcactcttggcgattgggcgcgcagccctgaatgctggcagcgaggaggccttggtctcgctagccagatcgatccaagcaaggcaaaaacctggagtaggcttgggtccaaaggagcgggtgggcttatctgatctgatcagagaaggcatcggttctggagaactaagagtgggtgatgcaagaaacctgctcaagatagcgccggaggttgaaccggtgctcccagctgagattaagaatcagctgggaaattacaaatctttgtcgtttggcgaggttgaggtagaagttctatctccccggggcgtcgaggaattggagaaagccagccctgagttgactgatagcgctgcatatgaggcgcaatttgacgcagctgggcaggcgacggattttgctttcgagccaatagcagaaggcaagggccacgcggtgggcgcggcttataaagacgagggtggtgcccgactgggggtgctagatgatgttgaagccgatccggctttaaactaatctggcactcctcgtgcgcaccctttggcgaggcgcgtgcccgattacttttcaaatttgcctgcccactatttttaaaagaaatagttggttttttggagagtctcggttgcgatagaaccattacacgg

SEQ ID NO: 2586 - DNA, 1000 bp, Rhizoctonia solani hypovirus 3
  isolate BR16 hypothetical protein1
agtcttatctagtcaataagacacaagtgcagaaggggagtttatccccgcctgttgttcagctaatcctctcaaaggaggctcaccgctgggaagcgctgaggaattcgcgattaaataccgcgcgttcatgaagatgacggagtaaaccgtcatgctgttcatcataaacattaaatcttttggaacttaaaggtggattcaaccaccgagtgtgatttgagcctaaaagccatcgaggctgaaatggaaagctcagattgtgcgagcccccttagggggattttgttctgttcaaagtcgttaaaacaggagattcaaccgcagagatgattacgcatcgagctcaaggtggggggaacaccggtggtttcaagactacgctctgcggatggttgcctggactagggcagttgacgatgtcctcctagttcacgatgaatgacgatgcttttgactatttggcatatactaaatagtgacgctataccgggatacgaaccggaacccctgctcggagagctcgtttgatccgacccaagttgcctatacgacttccctaatcttaagacaccaacgcgtaccgtgctttgcctgaattctgacgctgagactcttagagtggctgaagataatctggtccaacggccttaattgcgaacggtcattgcttaaagccccccgaaggttcaaccacgtagggatctataaaggcgatgaatgaaatagtgccaggcacctcggtgtttgttggccgttcaatgtttctggtttaattttgtggtccaccattccgtaagtgaagccccaatcggtgggttaatacggtcgcgaatgtccaatgagtgttaaggatagtcatggttataatgctaaggattgaacacggttttatatcgtctggcgccctctccaaggatggcaatttgttttgcgaggaaccctagctataagaattgggagtccctcaaatgtacgcaggccaatcatcgatgcctgt

SEQ ID NO: 2587 - DNA, 1000 bp, Chicken picobirnavirus
  strain RS/BR/15/5S-1 capsid protein gene,1
gtgtagaacaatggttttacacaaaattgaaaacattcaatcaattctgctcctcagccacgcagttacactgtgtgtttgtagcagcagaataagtcagaatgtgttaggaggtgacacttatgactaagaatcaaattgagtatctaaaattattagaaactcaaagatcaaatgttgcaaatgagaagctcacggcaacaagagatcaaactactcgagaattaggatttgctaatctcgcagagactagtagacacaatcgccaaactgagcaacatgccgttaatgttcttggagaaactgcacggcacaatcttgctcaagaagctttaacttcaagatcacttgatgagcaggagaggcataatagagtctcagaggatttgggatatgccactctggacgaaacgtctcggcataatcaagctgtggagttggaaacttctttgcataatagaaacacggaacgtgagcaagtccggtctaacaaggcaaaggagttcgaaacttatcgatcaaacctggctaaagaagttgaaactagaagggcgaacgttgctagagagcaggaaactgcgcggcataacaaagcaacggaaaagcaagcttctgctgaactcgagtattcctatgccaacttggcagaacagcgcaggtatcactcacagtccattggtttgggctactctcaattggaggaacaggctagatctaaccttgccagagaggctgaaacccgtagatctaatatctcccaggaggcactacggggtaagcaactggctgaagaggaaagatccaatcgccaggatgaagccttgacctcataccgaaaccgtgagcaggctaggcacaatcgagagtctgaagagctagaggagatcagaactagaagccaaagggttcgcgatcttacctcaggatacaataatctaatgtctggtgcgatgagcggcatcagaagcgctggtatgctaatacccttattcggactgtc

SEQ ID NO: 2588 - DNA, 1000 bp, Potexvirus sp.
  complete genome.1
aacaaaaagaaaattggtgaaatcctctttgaaaactataagagagccatgcaactcccaaatgacccagtagcattctccagggagctttgggatgtgtgcgccgacgaggtccagaaaacctatctgtccaagcccctccacatgatcaagaatggccagaacaggcagtctcccgactatccaaaaaacttcatcaccttgttcctaaagtcacagtgggttcagaagcttgagaagctcgggctcccaaagattaagcccgggcagacaattgcctcctttcatcagatcacggtgatgctctacggtaccatggctcgctacctccggagaactagagaaacattccagcccgccaacatttttatcaactgcgagagaactccggaggatatgtccaagtgggtccgtgagcactggaacttcaccagaacctcctacgccaatgacttcactgcctttgaccaatcccaagatggcgcgatgctccaatttgaaatcatgaaggcaagattcttcaacatccccgaggaagtcattgaggggtacattgacatcaagtgcaacgccgaggtgttcaccggcgtcctttcaatcatgaggctgacaggagaaggtcccaccttcgacgcaaacactgagtgcaacatcgccttcacacacacaaagtataacataccaaaggaatgtgcacaactctttgcaggagatgactctgccctcgacttctcaccagaagtcaagcccagcttcaggctgattgaaactgaactgtcactgacagccaagcccgtacttaaaatgcaaattcagggacaatgggctgaattttgtgggatgctcattacccctctgggcgtcgtcaaggacccaatcaaactctgggcttcatgggtgagggccaggcaaacaggcaagctcaaagaggttgcggacagttacgagcttgacctttgcctagcataccaacaccgcgatctgttgcaagaggtttttg

SEQ ID NO: 2589 - DNA, 1000 bp, Tomato blistering mosaic virus
  gene for coat protein, complete cds.1
tggaaagcttgccaaactctggccctcatgcatgattacatcatcttaatccttggtccagtcaagaagtatcaacggatcatagatgccagagatcgccctcctcaaatttacatccactgcgggcacactcctcagcaactatcctcttggtcccaatctcatctgaaaggctctgttttccttgccaatgactacacatcttttgaccaatcccagcatggagaagctgtagttttagaattgctgaaaatgcaacgcctttcttttcctcctttcttcctctctctccatcttcatctcaagacttccattgagacgcagttcggccctctgacttgcatgcgcctcacaggtgagccaggcacctacgatgacaactccgactacaatctggctgtcatttattcgaaatactcgatctccaatcatcccatcatgatttctggggatgattccgtaatctgtggttctcctcctctcaatcctcagtggcccaatctccagaaactgctccacctcaagttcaaaactgagcagtcagaccggcctctcttctgtggctattatgtctcccccctcggagcatgtcgcaatcctctggccctcttcgccaagctcatgatttgcgtcgacgacctaaccttgccagacaaggtcctttcttatttgtctgaattctcagtcggccacgctttaggtgactcagtcactgaagtcatcccatcgcacctcatctcctattactccgcttgtcatgacttcttctgtcgcaactgctcaccttcccaaaagctcatgctgagccttgatccaatcccagagtccaagctcatcaagttaatcctcaaagttcgctgggcttcaaaaagtttcttttccatgctcccacaaaaggccagagacatccttgtttccactcattctttccaatccatgccttttgatcctaaagtttcccaactagagtcggaattgcttcccaattacaattgacacg

SEQ ID NO: 2590 - DNA, 1000 bp, Burdock mottle virus
  genomic RNA, RNA 2, complete sequence.1
ctttactgtccattgctgctggtgggagcggcttgtttttcgcgcgggcaaaagtaaaggagttcctgctgaagatgaaaggcaatctgttcaaacgtgatagtgagcctgacaacacaggcggttttaccggcgactggccgtccaggtcgtctggagaaatttctttacaagagttgagtagaccatcaccggagttccaagctccacggcccctatctccgagagtgagggacattttagacgatagacacctggatgtcttatatgccctccgtaatggtttggcgtattgtgccgggttgtatgggttcacagacaaattcttggcgatcagttatgcgttacaaaccgacaagactctaatatctctcctggaggacgatagtcccttggacgcgatcaagccatcagaagatgccatattggcgaaccatgagtctgaaattgcgctgctacagagggagctggagttggaaaaactcaaaaacgagttagcgttggaaagagctagggcagagattgaaacattaaaaatgcggaaagacgtgcaggcccaagaagaactaaatgagttagccataaaggaacagagactgaaagccgaaactgcagagttttcacggaacaaagaggaggctctcacaaaattggctcagatggacgcagactcatatcaagctagacacacgggaataaccagcgttgctagtattaccggtggatatcttatgggtagggccatgcgcgggcctaagatgagtgcgtacactgctggggttcagggggtttccaatttaagttctattgacagcagcagggcacgcgctaattcaggttctgttttaagtgggtctagggcttcagttgctgcttctgttcctattcagcctgtaacagctagtactgcttccagcagtagggcggggtcgaacgtttttaccattaaggatctaggtagtggtagattacatacacctccacccttttcacctgcagg

SEQ ID NO: 2591 - DNA, 1000 bp, Hepatitis E virus rat/R68/DEU/2009
  complete genome.1
aaggtgtgtggaccaaaagaaacatttgtccccggtcggcagctgcagttctatagacagtgtcgggattgggtgtcagcaggtttttatgtggaccttagagagctctgcttcgatcgtgagtacgcctgcccatgcctcccttttgagcgggcagtgcgtaaaggatgttgctgtgtcgcccgtaagttgaaacaggtttgtgggtgctttatgtctgatgttgtggagagtttagaggactcgtgtgaggatctgacagccgacttttaccccaaaccagaggtttacgagcccgctggcttggataattggaccatccgcgctctcacggacgccttccatcaggcctccctgcgcgccgtgaggaccggtgcaaaactggctgggtggccggagatagggttggcattctatatcgcccccgtgggtattgtctttcgcggcgagcccctactaggcccccccggtcgccgattagaggcggggccttattgggctgatgcgccgccgccgcccacgccggatgaagcgccatatcaaacaccggtgagcccggacggccctcccccgcctgcatcttggacgccggggccgatctccccgaggtacgttctccctacacctgttacgtaccgtgggcatctccccgggtctgcaggcttctgggagtcgtcctccgcttccacacttgagggctctctgagtcgtcacacatccctccagagtgtcaacttggaccccccccgtaaccctcgagtccagccggtccagagggtattactggagttgctcccggatggggcggcagtttatgaaggggatcttttcaattcagattgcttctggcttgtcaatgcggccaacgcccaacacaaccccggagggggcgtgtgcggcgcgttttacggacgctttccagaggcctttgaccgaacccaatttgtccaccctaacgggtcggtggccgcctacacagtgacacccaggcccataattc

SEQ ID NO: 2592 - DNA, 1000 bp, Hepatitis E virus rat/R68/DEU/2009
  complete genome.2
actgcggttctcaacttggatttcactgataaggcatgcactaggataacattctttcagaaggactgcaacaagtttaccacggatgagccagtgctacacggcaaggtcgggcagggcatttcagcgtggtcaaagacccttgtggctctgtttggcccttggtttagggccatagagaaggcgattgtggacacactgcctgagtggtgtttttatggggattgtttttcccaggagaaattggaggacgccgtggccggggcgaaagcctgccgcgttttcgaaaatgatttcagcgagtttgacagcacacagaataatttctctttaggccttgagtgcttattgatgaaggaggccggggcgccccagtggatgtggaggttgtaccacctgctccgttcggcgtgggttgtgcaggctcctcaagaaagcttgcggggtcgatggaagaagcattccggtgagcccggtacattgctatggaatacagtctggaacatggcagtcataatgcattgttaccgttttgatgggttagctgtggccgcatttaagggtgacgactccattgtgtgctgccgattctatcagcaagagcctcgagccgcagccctcatcaccggctgcggcctcaaattgaaggttaacttcggggatgttggctcgtacgcaggcctgctagttgcctgtggtcttggggtcacccctgacgttgttaggttcctggggaggctctcggagaagaactggggtccggtgaaagagcggaaggaagaccttgaacagtccgtgcgtgacttcgtggcaaggttgcgcaacgtcactgctctgtcgtgcctgctcgccactcgcttttacaagctggagcccggcctggccctcaatgcagtcgcaggcttgaaggcgatcgctgaaggccgcatggagctgaaagagtatacctggcctgttctccagctggaggggaagaaggaataacactctggcccgtagc

SEQ ID NO: 2593 - DNA, 1000 bp, Tobacco rattle virus
  RNA-1 complete sequence.1
gatgtgaaacctaagactgatttaacaccgcaatttgaatactcagctctacagactgttgtgtatcacgagaagttgatcaactcgttgttcggtccaattttcaaagaaattaatgaacgcaagttggatgctatgcaaccacattttgtgttcaacacgagaatgacatcgagtgatttaaacgatcgagtgaagttcttaaatacggaagcggcttacgactttgttgagatagacatgtctaaattcgacaagtcggcaaatcgcttccatttacaactgcagctggagatttacaggttatttgggctagatgagtgggcggccttcctttgggaggtgtcgcacactcaaactactgtgagagatattcaaaatggtatgatggcgcatatttggtaccaacaaaagagtggagatgctgatacttataatgcaaattcagatagaacactgtgtgcactcttgtctgaattaccattggagaaagcagtcatggttacatatggaggagatgactcactgattgcgtttcctagaggaacgcagtttgttgatccgtgtccaaagttggctactaagtggaatttcgagtgcaagatttttaagtacgatgtcccaatgttttgcgggaagttcttgcttaagacgtcatcgtgttacgagttcgtgccagatccggtaaaagttctgacgaagttggggaaaaagagtataaaggatgtgcaacatttagccgagatctacatctcgctgaatgattccaatagagctcttgggaactacatggtggtatccaaactgtccgagtctgtttcagaccggtatttgtacaaaggtgattctgttcatgcgctttgtgcgctatggaagcatattaagagttttacagctctgtgtacattattccgagacgaaaacgataaggaattgaacccggctaaggttgattggaagaaggcacagagagctgtgtcaaacttttacgactggtaat

SEQ ID NO: 2594 - DNA, 1000 bp, Providence virus
  isolate 14EPF155, complete genome.1
gatctgagcaggtgggacatgcacgtccaagttccgctactcaagcgagtactggaaatatacagtcagcacgtgacgtgcccgctactgctggacatgtgcagcaacctcctcaagaacgtttgctacacaaacaagggtatacgataccacgtcgatggaggaatcatgagtggggatatgacgacgggcctagggaattgtattgcagtacttgttatagttatgtccttccgggacgttataagaaggcttgctaccacgagcgaaagcaacacgctcgacgtgctgggggaactgccctcaagtacggcaacccaagatcaggagttagtccggaccttattagagataagtccccgtcttcgggccgctcagttgacactggggtggctcagcatattagacgatggcgacgaccacgtgataatttgcgagaaacaacatacgtggatttgcgagctagtcctccctctgtggtggacagccatgggtcactccctgagagtggacggcacggcggaagacttcgagagcatagagttctgccaacacaaaccatggaatggtgcaactcggcttaccatggtgcccaacccagcaaaagttttgcccaagtcttgcacggtgacagggaagtacatcagcaaaccccagtcgtatctacgtactgtgtggaccgcccgggctatccttcacgtggatatcccgcttttgggcccatttttccagaacaacgccagacagttgtctggggcccctctaatggaggtcatcagttcggagtttcagcacatcaattcgtccctacattacctaatgagataccacgcgagtggtatgtacctgccagcacagcagaaggtggacgagatggacagggtgctgttttggcgaatgtgggacatttcgccaacggagcaatgtaaatgggaaacgacacttgctcccaaaaacaccaacgtttccgatattgactggccgtcagggtattgagatc

SEQ ID NO: 2595 - DNA, 1000 bp, Erysiphales associated tombus-like virus 1
  isolate PM-A_DN312481
cctgatgtcaaatcactagggcagcagctcgactcgttccgtgctacgaggataaactcgcattggggtcagaggtggccattgatgcctgaccttaaacaaacgccggcttggctcgactggcccccgtagaggggctaacccccactttattacaattatggctacaactacatcgaacccagaaactgcctccgtttattctttcgatgctcctaagcctacaattcgtttgcgccttcccgggaaaggatgtgccacttgtggcatgtccaagcctgtggaagtagcgccagtggtggtacaaaacgacgctcccgtgtcgatggagcatcatgttcaaggggtcaaggctcgtgtgggaccgtggatggcttttaagatgttgttccgtggctatgttagcccggtggcacaactgaaggccaagcacgccctcgagacttacgacaaccctgattatgatgagccctctgatcatttcacggatgtcgtcagcggttgccgcaaccagggtgaggaggcgatccaggcgaagcgcaagcctcgcagggataacacttcctggtggacggtttattctctgcttgcacatgcagagtttaaccgcccctctttcacgcgggcgaacgaaatggtggtgtctacttggattcgcaagcagatggctgccgacggggttaccagggtagactgtgccaaggtgctgggtgccgctactcggatggcatttgtgcctaccgagtcggacatctttgccgcacagatggctcagacccctgcgttccgcaagagagaaggtgaggcaaacaccaaatggtggactgcatggtgggattgcagaccgcgtggctacgaaagtagccaatagggtggcccagttgctgtaccaggaagggaagccggcgtttcgctggcccccaccccttccagtttggtggtacatcgcaaagtgggacatgccaatcgcgttcgacgcacgtacttggtggggcaaggg

SEQ ID NO: 2596 - DNA, 1000 bp, Carnation Italian ringspot virus
  genomic sequence for ORF1-5.1
aagctgttgatggcgtattcggagagacgacgtgcattaagggatacacagccgatgaggtgggtgcaatttttcgggagaagtgggataggtttcataagcctgtcgccattggtctcgatgcatccaggtttgatcaacactgttccgttgaggctttgcagtatgagcatagcttctacagggccatgtaccctggcaacaagctcttgggcaagttgttggactggcaactccacaataaagggaaaggttatgttcctgatggaactataacctaccgcaaggaggggtgccgtatgagtggggatataaacacttcgttgggaaattatctattgatgtgcgctatggtacacgggtacatgcgtcatttggggattaatgagtttagtctggcaaactgtggggatgactgtgttcttatactagaacgcagaaatcttaagcaggtgcagaagaccctaccggagtatttccttaatttgggatacactatgaaggtggagccgcctgtatttcaattggaagaggttgaattttgccaggcacaccccgtacagtttcaaggtggttggaagatggtccgaaatgtccgcactgcgatgagcaaggatgtgcattgtgtcaataatatacgcgatctggcgacgaggagagcatggagtaatgctcaacaccacggtggattagcactcagtgctggtatacctgtggttgagaggttctactccaggttcgcactatatgatgtgcctcgtaagcatcaacgcattgacactgtcactaatgttcacaagtggcgtggatctggtggaagttatgttgtgactcctgaatctagggctagcttttgggctgccttcgggttgacgggggatgagcaactagctttggaggaccgtctggatagatgggagatggatctgtttggagaggagggtgttgacgctcatgagcccagcatcctcgactccgccgtagcttgaccaagcgagac

SEQ ID NO: 2597 - DNA, 1000 bp, White clover mottle virus
  genomic RNA, complete genome,strain: CD.1
gtgagccttgttgatcaactggtagcccgggttttattccaagaacagaacaaactggagattaatctctggaaagctataccaagcaaacccggaatggggctgtctactgactcccaagtgatagagttcatcaattctctgtcccacctcgtgcaaataccagttgaagacttggtatacaattgggaaaagcacgtggtgcccactgactgctctggttttgactggagtgtttctcactggctattgacggacgaaatggaggttcgtaaccgtctgacacgcaacaacaataccctcacaagaaagctgagggattgttggttaaaatgtttatccaatagtgtgttggccttttctgatggaagcctgtatgcacagcgtgttcctggagttcaaaagtctggaagctataatacaagctcgactaactcccgaattcgtgttatgtgtgcttattatgcaggtgcttcctgggccatagcaatgggagatgacgctttggaagcagtggacactgacctatcagtgtataaaaatataggtttaaaagtcgaggtttcaggacaactggaattctgctctcatatctttgagaagcctgacctcgccattccggtaaatgtaggaaaaatgttgtacaaattgatatatggctacaacccggaatgtggatcgattcaggttctcaagaattatatcgacgcttgcacttcagtgttaaatgaattgcgtcatgatcctgaattagttcagcttctctactcgtggcttctccatccagtgttgccacaaaagtaagcgagtaagagaagcagacagatagccggtatcagttgttgcaatagccggagtcttagtcaacgtacaatcgtgaaaattgattataaatttctcgccggatttaccgcgggtttcgtgacatcaattccaatatcagtttttgcgatttatatcatctacctcaagatttctgcccacgttagatcaatagtta

SEQ ID NO: 2598 - DNA, 1000 bp, Apple luteovirus 1
  isolate PA8, complete genome.1
cagcaacggtgctcagtggttacgataattttaaacaggggagattgatcgctggtaagtggaacaaattcaggaatcctgtggctattggagtagacgcctcccgcttcgaccaacatgtgtcgacggaggcgttgaagtgggagcacagcatctacaacaaggtttttggggaccctctgttgcgtgacttgttggactggcaaacagtaaacaagtgcagtctttttgttgaagacaagatgttgcgcttcaaggttaagggccacaggatgtctggtgatattaataccagtatggggaacaagctcatcatgtgcgggatgatgcacaactatttccgtgaacttgtagtgaaagctgaactttgcaacaatggtgacgattgcgtcatcatctgtgaacgcaaagacgaaaagaagttcgacggattagggaaatggttttgggagtacggtttcaacatggctattgaacctcctgtatactccctagccaagcttgaattttgccagtcccgaccggtttgtataaatgggaagtatagaatggttcgtcgtcctgattcaattgctaaggacgccaataccatgctcagtatgcagaatgcagaagatgtgaagagtttcatgtctgctactggtcaatgtggtatgattctaaattctggtgtccccattttagacgcttaccattctaatttgtatagaggttcgggctacaagaaggtatctgagagctttattgatcgagtcatatcttatgggacagatgagcgcctccagggtcgacggacccgtgttgaggaaccagtaactatggaaaatcggttgagttactgggatgcttttggggttgatccgcaaacacaggtccttgttgaacgttatctcaacaatttgcggatcggatgcgaacccctgggagtgaagatagtgactcctcttctcacaagcacgttgcttgaaataccttattttaaacctcttaatttagcacc

SEQ ID NO: 2599 - DNA, 1000 bp, Rose spring dwarf-associated virus
  complete genome.1
aaagtcccacaattctttccggttacgatagttttagagtaggtaggatagtggctgcgaagtggggtaagtttcgtgaccccgttgctattggagtagacgccagtcgtttcgaccagcatgtctctcgacaagctttgaagtttgaacatagtgtttacaatgggatcttctgtgatcctattcttaagaaacttctcaagtggcaactcagaaatgaggttgtcctttttgtcgaagataagatgctacagtttaccatcgatcgaatgcgaatgtctggtgacatcaatacttcaatgggcaacaagataatcatgacaggactcatgcatttgtacttccgagatttgggagtccaggctgagctgtgcaacaatggggatgattgcgtgattatctgtgacaagaaggaccagcgtaaatttgataatcttgccgcttggtttttggattttgggttttccatggctattgaagatccagtttacgaactggagaagcttgagttctgccagggacatccactgtgcatcaacggcagttacaggatggtccgcaaacccgagagcatgtctaaagacgcgcactctatgcttagcatgaaacaccacgaggatgtcaagacattcctcagtgccacggcacaatgtggtctcgttcttaactctggggtaccgatcctggaggcgttccataggtgcttataccgtacttctgggtacaagaaagtctctgagggtttgataaagaaggtgatcagttatggtcaagatgagcgactcggtggcaggcgtgccattcgcgaggaaccagtaactatgggaaataggatgagtttctggaaagcttacggagttgacccgagaacacaggtccttgtcgaacgatatttcgacaatttgacggtcaatatcgaactccgcggtgtaaagaacttgacacctcttttacaaagcattcttgtgggagtccctgacttccctgatttcagccaaat

SEQ ID NO: 2600 - DNA, 1000 bp, Rose spring dwarf-associated virus
  complete genome.2
atgcaaatggcgccacctggaatgtaggtgagtacaacaatgttaaaatcacaaaacttctcaacacctcttcttggaagaaggggcataaagacgttgtgctcaacggttgccattttaatgacggtcaaatcattgaacgcgattcaaccatgtcgttccactgtgaagtgggacatggcggaggtacaatcctcctggttgctccccctgtttgtaaaagtgacaagtacaactatgttgtctcttacggcgagtataccaccaaacacatggagtttgggtccattgctatatgttttgatgagaagaatgatggagcaagagcagggaaattcttgggcgctcctttcccccgtgcaggtcacgtggtgcgtgagcaacaaacagaaattgcccgatttccagcaggtagcgacgtcccgattgtaaagatcagtgacaatgactttgctacctctacacaaccagctgcacatattctccctgttccttcatctgttcaacttcctgacgatcctgtctctaagaaggtgcgatcttggatcgagaattcgagcgaggatttgcgcctggcgcgtgaagctgaacagactgacagcgactgggaaccccttccaccacctgcaccccctcctggacccaggcaattgcccaccgacacctcaggtgccactcaggctatccgcaaccagatcctgcgtgatcatacgcagccctactctggccctggtactccgcccgtcttcgatgatattgaggatacgaggtcaaccacccgtactgaaagttcgcggcggagttttctcagtggtgtcctcagaccccagctcaaaccaaagagtaatttgcgtccgacttcctctctcccgcgtaagctaactgctgaccaggaggcacgagtgaaggctgtgcgcgagtcttttgggtctgccgctgctaaacgtcttagagacgagtttcttgaggggaaggtcagtcccgatcagatctactgacc

SEQ ID NO: 2601 - DNA, 1000 bp, Torilis crimson leaf virus
  isolate RL5 genome assembly, complete1
ttaagtgccggtgtgggggttcctttcatctcgtatgggaaaagaacacaccgtgattggattgaaaaccctaccctcctccccgtcctcgcaaggatgacttttgatcgattacagaagatatcagaagccaactttgaaaatatgacgcctgaggagctggttcagaatgggctctgcgatcctatacggcttttcgtaaaaggtgagccgcacaaacagagcaagcttgatgagggacgctaccgccttatcatgagtgtgtcattattagaccaattggtagcccgggtcttgttccagtctcagaacaagttagaaatagcgctttggagagcagtaccctctaaacccggatttggcctttccacagacgatcaaactgaaaattttgtagattgtctagccaagcaagtgggtgagacggctgatgaagtaataaagaattggccacaatatttaattcccactgattgctcaggcttcgattggtcggtctctgactggctactcgaagatgacatggaggttcgaaaccgcttgacccacaactgcacccccctactaaggaggctccgtgcaggttggctcaaatgcatttccaactctgtcttgtgcctttctgatggcaccctgctggcccaaacaaaacctggggttcaaaagagcggatcttacaataccagctcttctaattctcgaatccgggtgatggctgcttttcatagcggtgcatcttgggctatggcgatgggcgatgacgccctggaaagcgttgacacggacctatccgtgtataaagatttaggctttaaagtcgaggtttcagcacaactggaattttgctctcacattttcaaggagagaaacctcgccattccggttaatgtcaacaagatgttgtacaaattgatttatgggtacgacccggaatgtgggaacgctgaggttttgtcaaattatctcagtgctgtggtctcggttatgaatgaattacgtc

SEQ ID NO: 2602 - DNA, 1000 bp, Culverton virus
  RNA-dependent RNA polymerase, nucleocapsid, and2R
caagtaatcacctataacaaacttgatagacaagattatctaacttatcaccagctctactatactctaaactttgtagctacccgatttgtgagctccactctacaatagatactagagtaggttatctctcaactggatcagagacctcatcgcgtatgcttgtgagtgttctaaattggttagtcacgacaagtgtactagctcctctgtacctctactttactgggttgagatttcaagacctatttgtgtacactccgatacccgtaggtatcgaccaacataccgaactggccacattcggtgcaagtgattgcaccaacaccgccaacacggtagcggctacattttccattactccttcagagatctgctaccttagtgcatccttaatcacttgtgcatcactatactttctatatcaatcttggaacaccatgcataagtcagtagtaagaagcttagaggagatccgccggaaagcagtggagcaggaacagaagttgccccaggtgtccctgactggtctggaagatatttcagctcacctccagggtattaccaaagagctgaaggagatacgcttgcagttagaattattaactgatcaagtcaatcaacctcctactagattggcagcaaccgcaccacctttaccggcatctacaccaccagtaatttcttactatccaaacttaaatgtcccatgaatagtgctgagggataaccctggactgataacacggatttgaccatacaaatatgaattgcttcatccattgcttctctctagttattacttagattttagattctatgctttaccttactccaccacgaagctatactggtttttttagttgctattaatctcccttgtatttgttctctcccctgcttgctttttaaaaacttactatgccaactctaacaacactcagttcaaatccatcagtaacaaatgtgatagacaaattaactattacaaaagatagta

SEQ ID NO: 2603 - DNA, 1000 bp, Human respiratory syncytial virus B
  isolate HRSV/B/Bern/2019,2
caaatcaacttacaacagatacttcaacatcacagcacaggctgaatcatctcctcgcatcatgctacccacacaactaagctagatccttaattcatagttacataaaagcctcaaatatcgcaatcaacactaaatcaacacatcattcacaaaactaacagctggggcaaatatgtcgcgaagaaatccctgcaaatttgagattagaggtcattgcttgaatggtagaagatgccactacagtcataattactttgaatggcctcctcatgcattgctagtgaggcaaaacttcatgttaaacaagatactcaagtcaatggacaagagcatagacactttgtctgaaataagtggagctgctgaacttgatagaacagaagaatatgctcttggtatagttggagtgctagagagttacataggatctataaacaacataacaaaacaatcagcatgtgttgctatgagtaaacttcttattgagatcaatagtgatgacattaaaaagctgagagataatgaagaacccaattcacctaagataagagtgtacaatactgttatatcatacatcgagagcaatagaaaaaacagcaagcaaaccatccatctgcttaaacgattaccagcagacgtgctgaagaagacaataaagaacacattagatatccacaaaagcataaccataagcaacccaaaagagtcaaccataagtgatcaaaatgaccaaaccaaaaataatgatattaccggataaatatccttgtagtatatcatccatattgatctcaagtgaaagcatgattgctacattcaatcataaagacatattacaatttaaccacaaccatttagataaccaccagtgtttattaaatcatatatttgatgaaattcattggacacctaaaaacttattagatgccactcaacaatttctccaacatcttaacatccctgaagatatatatacagtatatatattagtgtcata

SEQ ID NO: 2604 - DNA, 1000 bp, Mapuera virus
  complete genome.1
caaagagtccagccaggccgatggttatgaatatgactcttacttagcacaaaatgcaaaaaccaacattctcaaaaggtggacagatgtaagcggggatgttgagccgatcccgatgaaccccgaagtgtttaagaggggggcagacctcaccaagcccacaaatcccaatccaggtcatcgccgagaatggagcattgggtgggttgggtcaacagtcaaggtcttggagtggtgcaaccccacctgctctccaattacagcaacatcccgatactatgaatgtgtctgtggaatctgccctaagatctgcccccgatgtgtcggagattatggacatgttgagacggctggacgcaaggattggctcagtagaggcgaagatggatcggattctagcagtaggggcgactgtgaatcagatcaagaatgaagtcagttcattaaaatcgatcactgccacaatagaagggatgattacaactgtaaggatcatggaccctggcaccccgagccatatgagtgcaactgaagtaagaagacagttgagtgacgtcccactagttatcagtggacccggtccagtcccccaacttgaccccagaagagacttaattgccttagatgagcttgctaggcctaaggttgtgcagagccccccggttgcttctcccgcaccctccatggcctcccagctaagtgatggcacccgcatcatgatccttcagatgataaaagaatgcgtctctgatccgcttgaacaatccagatttgaaactaaattgagcagctgcacaaccgaggaccaagggaaagcaataaagatggaaatcttacggagagcaacctaaaaactagctgacacactgctcaacatcaaccacccctgcaacccacccacatgcgcaaccgcagcccagagcacacacccaacaccgactcaatcaattaagaaaaaacataggcccgactggctgcaaacccagtcggaaccccggcc

SEQ ID NO: 2605 - DNA, 1000 bp, Bat Paramyxovirus Eid_hel/GH-M74a/GHA/2009
  complete genome.2
agaacaaatcaagaagatccctgcaatggagaagaaactatcagacattgaaaagcttctgcttaaaaccaatactgcactctccaccattgaaggacatatcacatcaatgatgatcatggttcctgggaaaacagtgaacgaaggagagatacaaataaatgagcagttaaagcctgtaattggaagaaaagatggtgtgtacgacaaaatgatactcccacgagtagacaagaaaatctcacttgtgactgatcgtacacctctttgtgatgatttcaaagaagatccttacgtgttaaatgagaagcttatccttgaccccatcaatccaagcgtaaccaatgcctcggcgttcatacccagttacgacaatatatctcctgctgttcttcgatccctcataagaagcaatgtagaagacagagagacacgagtggagttgattgagttagtgaatcaagcaagaaatgattctgaactcaatgagatactcgcattagtcaatgacattatagattcaaatcagtctggtgtgtgattcccaaaatcactcaactaactcaacaaacaacacacaatacccgaagtagaaaacaatgacactagatcgctacataactgtttcgcagtagctgcaatagggacacatgtaaatcaccaccgattacacccaccaatctcaaatcacagctgttcacgcatctttactcactgcttaagcaatgatatatgcaagtataattaaacaaaacttagggatcaagcacgatccaacgccggagagcgacaaagaaaaaccaaaaccagagaaacaccaaccaatctcccaacgaaactaagaggaccccacaacagcgaaacccatccaaaaggaagaagtcaccccaaaacccaaacccgaaaagacaaagaccgtcccaccgctacatcagcagcgcaggagtccaaccagctgaggtcaagaggaggaaggaacagaagtagttctacggacgaa

SEQ ID NO: 2606 - DNA, 1000 bp, Measles morbillivirus
  IC323-EGFP viral cRNA, complete genome.2
agcaatacccgaaaacgacccccctcataatgacagccagaaggcccggacaaaaaagccccctccagaagactccacggaccaagcgagaggccagccagcagccgacagcaagtgtggacaccaggcggcccaagcacagaacagccccgacacaaggccaccaccagccatcccaatctgcgtcctcctcgtgggacccccgaggaccaaccccgaaggtcgctccgaacacagaccaccaaccgcatccccacagctcccgggaaaggaacccccagcaactggaaggcccctccccccctcccccaacgcaagaaccccacaaccgaaccgcacaagcgaccgaggtgacccaaccgcaggcatccgactccttagacagatcctctccccccggcatactaaacaaaacttagggccaaggaacacacacactcgacagaacccagaccccggcccgcggcaccgcgcccccaccccccgaaaaccagagggagcccccaaccaaacccgccggcccccccggtgcccacaggtaggcacaccaacccccgaccagacccagcacccagccaccgacaatccaagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgcaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcaattccccacccccaaaggagacaccgggaatcccagaatcaagactcatccagtgtccatc

SEQ ID NO: 2607 - DNA, 1000 bp, Human parainfluenza virus 1
  complete genome.1
aacgaagagtcagcagccactccaaagaacaaccacaaccacagaaaaacaagatacacaacaaacaatgcaaacaacaacacaaaaagtccaccaactcccgaacacgacgcaaccgcaaatgaagaggaaaccagcaacacatcggtcgatgagatggccaagttattagtaagtcttggtgtaatgaaatcacaacatgaatttgaattatctaggagtgcaagtcatgtatttgctaagcgcatgttaaaatctgcaaattacaaagaaatgacatttaatctctgtggtatgcttatatcagttgaaaaatcacttgagaataaagtagaagaaaatagaacattacttaaacaaattcaagaggaaataaattcatccagggatcttcacaaacggttctcggaataccaaaaagaacagaactcactcatgatggccaatctatccacactccatataattacagatagaggcgggaaaacgggaaatcccagtgatactacaaggtcaccatcagtcttcacaaaagggaaagacaataaggtcaaaaagacaaggtttgacccctctatggaagctctaggaggtcaagagttcaagcctgacttgataagagaggatgaactgagagatgacatcaaaaatccggtactagaagaaaacaacaatgagcctcaagcatccaatgcatcacgcctgattccgtccactgaaaaacacactctgcactcactcaaactagttatcgaaaacagtcctctaagcagagtagagaagaaggcttacatcaaatccctttataagtgtcggacaaaccaagaggttaaaaatgtaatggagctattcgaggaagacatagattcactaactaactaaacatgaatctacaatttcaaccagcaatcaaaatcaatatccagagccaactcaaaaagctccctcaaaacaattaagaaaaacttagggtcaaagaaattttgcccggagaaaggaa

SEQ ID NO: 2608 - DNA, 1000 bp, Rice yellow mottle virus
  from Nigeria, complete genome.1
gagctggtagagaaaggtctctgtgaccctgtgcgcttgtttgtcaagaacgagccacacccacggaagaaattgcttgaacgcagattcaggctgatctcttctgtttctctagtcgaccagctggtggagcggatgcttttcgggccccagaacaacaccgagatttcgacttggtggcagtggccctcgaagccgggcatgggtcttctgacccctgaacaaatccgtttggtgtgggacgacgtgttccagaagcaccaggcccaccctgcggctgaggcagacatatcggggtttgactggtccgttcaggactgggagttgtggtcagacctcgcgatccgtataaacagagggaatttccagggaaacctcaggagagcggctatcagccgctactactgttttatgaactctgttttccaactctcagatggaactctcatccagcaggaattgcccggactgatgaagtctggctcttactgcacctcatctacaaactcgcgcattcggtgcctcatgggtgagcttatcggctcgccgtggtgcatagcgatgggcgacgattcagtggaggggtggattgaggggggccagtccaagtacgccgcgctaggtcacacctgcaaggagtactacccatgtaagaccagagggcgcgagctcttggaattcaacttctgttcgcatttgatcaggaggggtcatgctgagctaacttcatggccgaaggcgttgtttcgctttctgtccagcaagcatgaggactttgaggatctgtgggttgagctccacacgtgcggggtgtggggccggatcgaacgatatctgcgtgggatagggcgtgtctcccacaaagatagccaggaagggcaagaaaaccaaccccaaccaggggcagcaaggaaagaagaagagccggcgtccacgtgggcgttcggcggaaccccagcttcaacgggctccagtggctcaggcctcccggatatctggg

SEQ ID NO: 2609 - DNA, 1000 bp, Colobanthus quitensis associated barnavirus 1
  strain CqABV-UTus4531
cgtgcgcaatggcgcgtgtgatccggttaaactattcatcaaaggagaaccacactcgcagaagaaaatcgttcagggttttcttcgaatcattgcaagtgtatccctatgtgatcaacttcttacgcgtacgattagtgcgcgtcaaaataagactgagatcatgaattgggaaacctgcccgtcaaaaccgggtatgggtcttcacgatgaaggtcttgccaaactctccgagaatgctcggagaatactaacggaaggtcgcatcatggcgactgacctatcaagctgggactggacagtccaagaatgggagctggaggtggacgccaagaggcgtatattactggccgggattgatgaagatcacccaatggccaaactcttaatggcgcacgcccacatcgtcgccaactcggtctatgtggattcggcgggtaacatgtttgcccagacaattcctggaggtcaactctctggggattacaatactggatcatcaaactctgcgatgcgtgtaatcgcgactcaagctgctaggcttaaggtaaatcaagaactttaccttgagcgcatttcggctaaggagttgcttgtatgctcaatgggtgacgatacactcgagttggaagtcaccggcgtgccagaggtcttagaggagatcgggcatattgttaaggatgtggaattccatgagacactgcaagatgtagagttctgttcgcaaagatttaatgcggacggttcagcctatccagtggattataacaaaaccctttacagattcctttcgcacgctcccgacgacgtagagtactcctcctacaaggctcagctcatgtacatattccgacacatgaatcaggaggctcgcgataaaattgagcacacagcactagtccgggttgagcgggctagaaaattattctgtgagaaaaacaaattgtaagttaatatacaccatatctactgtgcttcgacatatatttggtagcttgca

SEQ ID NO: 2610 - DNA, 1000 bp, Linepithema humile polycipivirus 1
  putative capsid, hypothetical2
tcagattcgagttatcgtgaagttcagcaaaattcttttattcccgcagatactagcatgttccggcatattgagttgacaatgccatatgaatatcccaccccgtggtatgatcagtttgcctggatgtcccgtagagtaactccctcgcgttatgttagaagtggtgacatttctttcgacacattcgcagccccccttacaaatgagcctcatggtgacaatttcttcgccatgggacttcgtggaaatcttgcagccacccaagaaggagctcagatcgagttcgagttagaatatcgagctgtggaagggtttcagttcgctgatccttaccttccaccagcatattttgcaagtactcatcgtgatctcctcattaatgactttgacaagattaagcgggttccagatccgactttgacttcagatggtcttagtaaaatcactaaaacaggttccaggactgtaagatctgtttcatctcaatctatagctcaaaggagaaaggctgatttgaagctagatctttctggaatagatttaggagaagatactgtagaccccgtgatgcctagtggatatggatctcgcgaacgggaatttactttttagagtttaggtcatttttcattcatgttcattttcagttttaaaatgaaactcttcatgcataaccatgagttggctaattacgtgacggttcctagttatgagcaatctaactccgaatatagaggtgaaactcttgacggccgggaacaagtagcgtgctttagtcgagcccgtaagattgaccaacgcaattcttgtatcagaaaaaggagtttttatccctagactcattgtatgtaatgctgacctagtcaagtcttaggacgcgctgtacaataaacgtctatgcaacgtctcggtgggcgttgcattcagggtgcagtctaacctgcattactcccttgatctgtgtcggagcagtagaattgtgggcggactaattaac

SEQ ID NO: 2611 - DNA, 1000 bp, Polycipiviridae sp.
  isolate nut158pol1 genomic sequence.1
atctaatatggtaggtagtatatttggacccgcaggagttttattctcctcaatcgcttcgccctcggatttcgcatcacaatttaatacaaattatcaagttgaaacaccatctggcgcctttgtaaatgctcaagatggatcaaatattaatgcagatagttatgtcggtagcaccagttagaactccagcacaggcaccattacagcctatgcaaccaaatccccagacagcctgcggaactttggatgacggatgtgtttataacactatggatattcatttaggaggacaacaacctaatgaacagttttgggctgcacgtagtgaatattgtaatcaagtacaatggaccactcagcaggccataggaacgaccctggcaacgattgatgttttacgttattgtggagatgatatgaataaccctgacaaccttaatgcaaatggaggattacaaactagatccagagcatatggtagagtaatatggccaagatggttaattacgaaatcgtcgacttatatctctgtctctgttaaatatgacttctggcttcataaaccagtaggtccagtagtaggaggtaagttgaggatatcgtataatcctggtataagaaagaattggaatactgtgctaaatagcattggaagcactattgattcctatcaagattctctgttcagagaaaatttatgggaatgggatgtaaaagcttctgatacttttagtgtcacacttaatggcaatataccaactaaatacattactagtaccataccaagtacaagattttcagaggttgcagatccacgcgagtgttttccagcatttatgacaagttttggaacgttagagattagtgttttgaacaattatgtagcaggttcagtttttgctgattctgtatttatatctatttataaatcatttccgtctttacaagcttatatagttcgtggccaccgaaatgaccaattcttaactgcaattta

SEQ ID NO: 2612 - DNA, 1000 bp, Sapporo virus
  isolate Hu/GV/0003/Sollentuna/2016/SWE, complete1
aagcaatggaaaatggggcttcaccatcacacctccttccacgcaggctccagagggctcgtggcaacagagctggtggttatgccgtgggtatggtgattgttggttcggcacaccaggtcaaccgccacttcacggcgcttggcacaacttttggctggtccactgctccttatgagccaatgcggtgtgcgtttggtggtgtgcacactggtactgacacctctcccaaaattggctattattgggaagtcgggtccgaccaacgtgggcccatatttccccatatagtcaatcattggccagattttgctgtgaacaacacctactcatggccaggctcggagtttgtccctcaaaacgccattgtcggtacacttgtctcctttgctgacaatggtgatgtgtccgagaacgaggtggtacccgcatttgcggttacaatgaacactccttccaccagcactcgaggcaccgtccgtggctcatttgacccatccaccatgcatttggtgcgtactaacagcactggacaaccatctgggtggccatctggcccaaacaatgggaatggatatttcacaccaatgtggggacatggtcagggcaatgctattaatgataaaatcaccaacatggagggtgtgaattacaccttcggaggctctggccaaaacaacattgtcttgtggattgagaggatcttctccgaccaccccggaaaaacaaccctgtactcatctcagctggacagtactgccacaatatttcaatctggtcctgtcaacatccctgagaacatgatggccgtgtataacgtcaccactaacggagctgacttccaagttggcattcgacgtgatggctatatggtcacttctggagcaattggaacacagcaagagcttgaccccgacacttctttcacttatgttggacttttccccctttctgcctcacttgttggcccacatgggaatgctggacgggcacacattgc

SEQ ID NO: 2613 - DNA, 1000 bp, Nilaparvata lugens honeydew virus-1
  genomic RNA, complete genome,1
tcaaaccttccaacctttcttagttttaagttgtatcgattgtatttgtgtgattattcataataattgcccatcttttctttcgcaaatacatctcttctctaagtgtgaatgtttctgaacgttgtatgaatcagtttttctcttccaatttatcgaacttgtgtatatgtgagtgtgaactaatttttgattctttcttttcgtttcgatgactaggactgattaccctaccattgatcctaacaatagtcacgacgggatagactccgtgcagtgtttttagaaatccggttggactccggtagcacatacgatgacaccacactagccagagtcggcgtagtcgtattgtgttgtgttccctactagagacccaaagcagcgttctcttattcattatattcttgtgattctgaaatgaggtttgttgatttgcttgtggtagtgttgattgagacccgtttccggtaagctgcttggtatcgtgatggcatagtgatgcttgatctgaaatcacagactcgtgttgtcgcccgctacataatttaaacgtattatggaactgctagacatctactggtcaaatgggagaagcaacatgaggtttgtttcttttgtttgggatcacggataaacagcttttaagaagtccctgcgctccctagcttgcagctctatagcgataagtcaagtgaagttagtaaactcttcttagctggtaatgagtatgtgctatatatcctggataagtcccccccagggttgatgctaatggtaggtgcacaacaggcaggtgcacctttgtcgtgggatgtgaattcgttctgcccgggcaccatagaatgactagtgagtagcaatcgatgtagtaccctttcaatccatatagtctcaaaattacctggcagttgttttcaacgtgaacacaactgctttcgttctgcctaatcctatattttaaagtttttttttaaattttgtttgtttgtgttacaat

SEQ ID NO: 2614 - DNA, 1000 bp, Iflaviridae sp.
  isolate ybb117ifl01 genomic sequence.1
aggtttattttgaagcgttttgttcgattccgatcgaccatagaaaaggtatattatgttcgcatctgtatcatcgcttcaaatttaaagttttaaggctttttattattggagaacttttgaaatttatttggtgagcctttagtctttgagttcgatacttagactatttaatttccagatatctatcgtccaagtagaatctgaggggtttaaagcaggagccgtgagtcagcccagacaagcgtagtactgttttattccgaagtttgcgttgagcgaccggcgtcggtgcgtcaaacaaaattccgaatggagttgtggttcgagcgagtatctatacacgcggatcatgtgggaagttttgcttactgaagttttcaatgatatctaacattggccctcggatcaacctaaagactggaagtacccgaccaacgcccagctagtaagagtttaaatactcgcgagcagttagttggcaatgttatttggatttgtttatgaatgtttgagactccgtacctatacgatgcgttgattaccatcagaaaaagctctagtaatgaaataattatagcggtttcctggactatggtgtaatttcagttacatagtgactactttacaatcaaagcctaaacaggcattactataaaagaaccgtcgtgttagcattgtgtttggctaacatcccaacgatagttggcgacattgaactgagagcaacatacgttaccaattcgattatcgttcaaaaagctctgggcaggaatttgaaaaatcaaacttcctgctaaagttaaacacacaaaccttattttattttcctaatttaacgtttacgttattttatgtcagttgttcgtttgatagaagaagttgaagaaaacagtgaagaaatacatccgtttcaacaacgattacaagaagcaagtacaaatttccaattacgtcgatcaaattatccaataggcacaacaagattatacaatcaaca

SEQ ID NO: 2615 - DNA, 1000 bp, Iflaviridae sp.
  isolate rfb094ifl1 genomic sequence.1
aggttatttaatcggtgacagactgtgctctgcacttattatttagcataacttgtacatatataagaatctaattttaaatgaacttacgaaaatcaacagtccacctgaagattgattaggtttagtatagaggttttaaatgatttcgatcatttatataaaagatgtattatattcgtatctgcatcatccttttatttttaggttaaacagccttggtgacggcttgagttctgactatgtacacccacgtagccgtggtaccgcttttcagaatccaccctggcctctctcctttttaagggagtttcctggagagagtaatttgcaccgccagtatcgatcttacgataactcctcccttaaaagcaagacatagtttgagtatatcagacaaacgttatattatctagttgcatcctcaatgaacaaggtattctgcatccttaactcgcaagggttattgaagcctcatatggacgagtccaacccatatgaagtgtccagttactttatttcgcctctcgcaagggaaaagtaaagtaatgcactaatattgaccttcaaggttgttggttattattagtagagcctttgataatataatcgtatttgaattctcctaaatattgtgtatgtaaggcgctcacggtcccgttggggtttatgcatcatgtcggccacgtgagtatgaagtggttctagtttactatgatactgcaaggcaggccggtgtggatacaccaaaaaccaaaacataaatacacctttagccatcttttgccgctttctgcgagttttctgcgagttttattattccccaaagccattattagctaccttttatgtcaacagtgcgattaatagaagaagttgaagaaaactgtgaagaaatacatccgtttcaacaacgtttaagagaagctagtgcgaattttcaactgcgacgatcaaattatcctattggaacagctcaactttatagacaaagagaaca

SEQ ID NO: 2616 - DNA, 1000 bp, Picornavirales sp.
  isolate H4_Rhizo_43_scaffold_10 hypothetical2R
gcagtgagcaaattccattgcagtcgaggtttagcctcgccattcgtcttttaaaattagtttcttttaagatgctagaagataaaacacggtaaaaaattgtatataacgatataggtctggagtatagtaatcaatgttaattcgttgcattggtgataacgacatactgtatactcccaactttcgcgccggacgattccggatatattgtacgtgataataatgtcttcttaattgagactgactttttaagtcaattaaacaactctaccagagcctacgcgttctatctctgacacgggatagttctcagggttgaagattccataggtcttcagcctgccgaaactctgtgctgtaatgtagggtcgactaccatctacctatttaggtttgaatcggtctgagataatttcaatacacgaccggccttaaaatagttcttcagagccaccggatggttagtttagatgtggcatagcgaaaaacgcagcacactgatgatattctttcaaacgaattttgttccctcacgatcggtgaggacctgcttcaagcaggagataatggatttttgcttgcccctgttatattagggcaagctcaagaaactcatgtacatggacctactattgtacgtgattttacagattgggacgcctttaatttgtggcaggtcccagatctttattatgatggtccggaagcagatttagctgaacgagatggttttaataactatcaaaatgaagcaaatttgcgacagactataactaccgtcattgaaaaagatctacctccttatgaggtgttgatttttagtgatgaagaagaaagttctcgaactttcttttcctgtgagtcggataatgaagggtacactccttcgtcttctgattcacaagaacagatgcctgatatcatatatcagatgccctttacagctacttctatacaaaaagaacctgaccaggttcagcagaagttagttaaaagg

SEQ ID NO: 2617 - DNA, 1000 bp, Picornavirales sp.
  isolate H4_Bulk_Litter_22_scaffold_31
ccttcaatagaaaatatgcgtaagttaatttgtatgttttaattttagactaaaaatataaacattctgtactatcaagttagtatatgtaaaatctttatcagacgatcaatctgattataaaagatttgtacatataaaaccttgtgtttgtacacgcttatgacgtgagaaagtgcattgagcgatatcaatgtggatagcttactatagctatccgttagtcttgaacgatcaaattcaggagctataaatggacattagtccaaggtctttaatcatgtaggaccttctttttaagtaaaggaaacatgagaaccacacatgggaagttattgccctcatgtgagtccagctaaatagtttggcattaggtaaagattgcagtgagcaaattccattgcagtcgaggtttagcctcgccattcgtcttttaaaattagtttcttttaagatgctagaagataaaacacggtaaaaaattgtatataacgatataggtctggagtatagtaatcaatgttaattcgttgcattggtgataacgacatactgtatactcccaactttcgcgccggacgattccggatatattgtacgtgataataatgtcttcttaattgagactgactttttaagtcaattaaacaactctaccagagcctacgcgttctatctctgacacgggatagttctcagggttgaagattccataggtctttaacctgccgaaactctgtgctgtactgtagggtcgactaccatctacctatttaggtttgaatcggtctgagataatttcaatacacgaccggccttaaaatagttcttcagagccaccggatggttagttcagatgtggcatagcgaaaaacgcagcacactgatgatattctttcaaacgaattttgttccctcacgatcggtgaggacctgcttcaagcaggagataatggatttttgcttgcccctgttatattagggcaagctcaagaaactc

SEQ ID NO: 2618 - DNA, 1000 bp, Picornavirales sp.
  isolate H2_Rhizo_32_scaffold_97 hypothetical1
acaagatagtggagcttctcaggttagaccgtgtaatgacgttacctgagtgatatgtatcccaactattgtttataacaatgaaccgggttcttggtatggtgtgtgagggtcagcctcaccggagtaatgaaccgtacgaccaagaactgctggaatgctttgttattcacacttaattgtgtgcaattgtgagttgccatacaactcgcgtatattaaattttacttgtttttggataaacatgataacacatatctttcattccgattatcccatgtcggggatatgatagaataaaggagtgtacttgatatctatggcctggagctagtatgtccaggaataaccaactatcaaatacggcaggaggaattattgtctagccgacaatcctctgaagatttaggttaccagccaatttagattgaaagattatgacccagaagtcgctagagctactaagctcgcgcacgtccgtgttttacaacaacaaagagaccagttcctttctcataggaaggagcaggtccaagaatttggagccgattttgtcttggctcagttcttaaataagactgtagaacctatatctacttctccgggcgatataccagaaaagtataggagaggaaactttccaattcgagataattatttgtctttatcgttacatgatgaatataaactcgatagtgactctattcgtcactactccttaaacgaccgaagctcgaggagtcaaaaaagagctaatgataaattacgtgaaaagtatgatcctaaatacttagtagcagtggttcgggtgctcaaaaaacctgaacctaccgaagatcagttacgtcgtcttcgaagattttggaatctccttgagggggttccagaatttgatattgattcactaaaacaatatttctttactgtaaatcatattttgtttaagaacaattggttttccaaagttgaaacttggaagtcaagaagtttctttacattt

SEQ ID NO: 2619 - DNA, 1000 bp, Picornavirales Q_sR_OV_041
  putative polyprotein (Q_sR_OV_041_gene1)1
ataggagatacataacaaagaaaataataaaaattcttttgtacatatcaaaggtattggtttgactgagcacttggcgagcgagtgcaaggttgcaatgtcttaattcacggttttgaacatgttccaccagggatcgtacctgcatgttttgtcgccttaagtggcggactataaatatactatactcaagtggtgtgagtgtatgtttgtagcgcagttcgagagccgaataattcttaatattgaattgtgatgtgttatgttttgtgtagtttgtattttaattgtatgcgtagtaccaaacgctcttttgtgtgtttatgcgatcacacttactttgttggagcgatacgatcaacgaagttaatgtcttaatctaaggcctttgccgcatgtggaagaaccaatccggcatcgtattataccccaaccgctaatgaggttggatgagggcaaaatcgtagctcatctaccttctacccttttaaaatggaggagagatgctatactagggccactacaggggcccgacccccaaacctacgtggtgatgtgtgactttggcgagatggtaacttgccttgtccggtaccatatgagctacttctacattagatatagaatgacgcgtttagctgaagacccttagtacctccggtgaaagttgtgcccggaatgtggttgaatatatcttgtggttttagagtagttatgtatgggctggaactgttgtacacactttgatgagtgctccgcattttccctttgcgaataagagcacaatgattctatacgtgaagctgatacattttcagagacttatcgtgaatgatatacgtttttgtagatttgaagggccctgaaaaggtttaccctagtctgaattcctatgtcttagcggtttgagatggaatgttgttgcctatagtacgtaaggttgaacattgccataggcaatcctcaagggattggcttggcgatgtgggaataaacttca

SEQ ID NO: 2620 - DNA, 1000 bp, Picornavirales sp.
  isolate H1_Bulk_28_FD_scaffold_4 hypothetical2R
tgcagtaaccgctgcagtgaccagtttttaggtccctatagtttgacctagaggtaatctaacagcaaatagggattctccgttaaatcggaggccagctaggaggccaatctttgtggaagccttataggtggcacactggttgactatcggcctatccatgtggaagctatcccggtttcataccggattctatagtggcatatgtgtagactaggctcgtaatatccaaggaggcctgttgcggtcttaaccgtagcagactatcgtttgttgttcttaggctctttgcgttctttgggaagttttttctttgtccatttgacccaaaaacccagttcggcccttatgttatgttgatccggtcctttaggcctttgtgtgtgtaccacgtagtttaatagtgcaccttatcgtatggataccaagtgcgattcgtattttaagattggaattttgcgccacacgtcgtatgttgcttcacgtgtcttgtagtgtttatacttagacattattcgtagtttaataagtagagagtgagcctcgatttattcgtgacactgctctcacaatcattgactaatatacaggtattggaactatcttcttatgtttcagtaggctgatgtctttgaaatccctttttatgggtgtcccccacttttaggctgtcagcgatcttgctgccaggcaaaattatagagggctccgattgggtgaattgtgaattaccccagtatgagtttaaacaaatacccgcacagcaccatctcaaattattgatggagcgcaactcggtcgccttgtaaccgatacccccgaaacaaccgcgaatggtaacaattccctggtaccccccccggcccttatcaagcacaagaagtctgcagaagaaattaaatttgaatctgtagatcctactttatttgatgagtggattcaaaatgttgagattgagcaagaacctccaaaatctattcatagattgcggaaatgtttg

SEQ ID NO: 2621 - DNA, 1000 bp, Barns Ness breadcrumb sponge aquatic picorna-like virus 2
  isolate1
ttgtcctttttaaacataaattagattgattcttctcttttgagatgtagaactatacctggttactaatttaagtcgattttaatttcattattttgcatttgttttagagcgcatgaagctcactgaataaggtttcagtcaattccttttcagctcttatttatataagatataaacattttcattattttggaaaataacgtaataaatttcagtattttatatgtgtgtaggccggtaccgaatggataaatccgatgtcctgatcattatataccttattgcttgtagaacactatatgaccgaatttgaagaatagggttaagaaagttccccgttctatcaataacaataaaccacccttcatgagaaaaaagttacttacagaaaataaacgaattattggtggtaatattgacaacatgggttttattttaaaagaaaaaatggacccatcctccgcaaaggagacgcgacgaattaagtttcgacgcaaaaaaatacaacgagcgcgaagcagctcgcagaccttttaaaaataataaggtttggaaaaattcgcaaaaatggaaactagagtttgaaactcttcctgaactggatatcatttccgaagagtcctatcagccacactttggcttagagactatttcagcagcgtcattttcgattgacgctttggcaaaatttgccaatattgatattccagataaagttttaagagaagtagaaggagttattcttcttctagtaaatctttcacaacaaagtacaccattgggtgtcattacgtcagttttgacttgggctcaaggtcgtaccacaaaatcactttttaaaacagtgaaaggatttgttgaggaacttctcgtttcaccacaatcaagcgcaaccccagattggttggattgtcttcgtgatgtccgccaaaattggcaattgtgtaagactaatagagcattcaaacaagtgtcaaaacttcttggttgtctcgtc

SEQ ID NO: 2622 - DNA, 1000 bp, Picornavirales sp.
  isolate H1_Bulk_30_scaffold_14 RNA-dependent RNA1
gatgatatcctctccttagtgaaagtattctaccgtttgtaattgaaaattgtaaagttggtaaggtatgtcggattcactggtattttaatacctctaccgctgatcgaatggtgtaagatcagggtcatgcggggcagtgccgcaatgctacaccatgttcaacccttttgtttgacgcccccagggcttccgaacacacatggaaaaactaaaccccccctcctctttctcgattgaagttttgaacagagtaagcgctctgccaaatgtggatttgactgttgatggcaaaatgctcccagttgttggttcaactggcggtggtcctcgcaagccaaagttgcctgccaaggacttgtgcctccgtgaatgtgcacgtgaaggagaaaggaaaggtgcagtgaacctgaaagagaaatctagtaaggccttttccaataggggaagcgttgagccggtgggttttactcaatcccgtttgaaagcgaaagcaagtaatagggagcagagtcttcaaaggcattgggatacgtcgggcattactgccccccgtcaacatcgtgaaatgctgcagcgtttagctgcagagagacgcgttgttgaagaatggaagagcaagggaaaagttgaacgtaagcgagagattctgcttaagcgtgataagcgttctggcgttgggattgagttccagagaggtaggtttatgcctgcttcgccggaagatttgttgcctgatgcagaagctcaggcgaggactgatattttacatgcgtgcaccgagaataaaatgccgtttgttcgtgatgttcgtgacattttgcacacatctgcgatggcacacaggatgatgactgagtatggcgaaggtgaggatcacagtgagttatttgagtttttaccaaaacatattagttccaagttgaaaccccgttcttttgagttacttgacgttgaatggcagtctggtaaggttttaccagctgttgcaggagtagcc

SEQ ID NO: 2623 - DNA, 1000 bp, Auricularia heimuer negative-stranded RNA virus 1
  isolate CCMJ1222,1
cagtggcggaagtccgacaccagctcggccaggcaccgacgcaggcggtgatgaatgctcttgcagctcgcggggagaccgcatcccagacggccccgacgccagagtggcagcccgaagagactcgcgaggctgacgacgaggacgacgcgttccaccacccctcatcgaacgcggacatgatggagaggatagagtcgctgtcgcagcagctcgggagcctcaccgagtggaagtcctccatcgaggagaagatgcaggccctccataacgatagcaagagggccgcggacaacgcctcgtcgttcgagagtcgcctcaaggaggtgaacaagggcattcatagccgtctcgaccgcatgtcggaggccttagagagcctcgggaagtttgtcaacacccagcggcagatcctgccgcagcgaccccgcgcgccggaagcacaagcgccagcgtccctacctgaggacgtcaaggtcgaggtcatccacccggacgctggctccctgctggatgcgcctggccgcgcgtcgcaccaggagcagctgctcccgaggtccctacgtcccgcgccgaaagcgcctgagacgtcgaagaggacgacggccgaggacaagaagaagttctcagcagacgctgcggcggctctagcaactcgccaggagtcgtcccctcgcgcccgcgccgcgggagcgaagccgttcgaatccacttcgaggcggaccgcgcttccccccccgcctccccctatcgctttcgacgactcctcggacgaggaggacaaagaggaagtgggtgcggtcgaggggtacgacgaccttgagtgagctacgccctgccttccgtgcgtcagcgccacgatagcagctcgagaatgtacttgtaagattagacgcttgaggatgccggcctggacgcgcctctatcactttgatgatctcgccgcttagaaaaaaccaagagacaaatcgatagatattgtctctggtatctcgccgtg

SEQ ID NO: 2624 - DNA, 1000 bp, Auricularia heimuer negative-stranded RNA virus 1
  isolate CCMJ1222,2
agttgcttgttccctttccgcagatgttaaaaaccaaggagacaaaactgatgattgcgtcttggttgaacgctcagcagccgcgcgccgggataagcatctccggagggaacgagtatgtggagcagtccgacttcgggtccgagcccgctctgaccggccagatagatgacctcagcgcgatctacagcttgtaccagaagcctaacaaggtcatcgtgggggcggacgtactgccgaaattcgcgcactcggtggatcaagacgctcctcaccccgcccctcatctctggaccgaggatatccgtgctggcacctggcatcgtggaggtctaaccctggctcagtgcgacttcccgaatgtcgatgctgttcgacgagagctcgtcaagcaaaactcttccgagatggagcattggaccagaggactgacagcaattcgcctcgtgaaacgcacgcacgctctcgtccggaagattcacaacctgcttaagagcactctctgggccttgatgactcgcgtgtacatgaacagcacgacggacgctgacatccatcgtctgctcgaggagaatcgccttgagtctcactccctggcggagtacacgacggcgatcaaaggatacacggagcatatgcacgagatggtaacgacaacctcagtcgtagtccctcagtctgctcctccgccgtcgtctgtctcctcgttgtcttccctcccgccgcctgatgcgtactcccccctccgaggggctcctctcctccctcacttccaggagcatcgcaaccgggcctcaacccccagcactcctcgagctcgctaagatgatgtgataaggcgttgcgtgctctcgttagaggacgctcgcgtacacatctgatttatgatctgttagaaaaaaccaagaggaacaaaaatgcagctgcttggtctggtaccacacagcgtgagacaaaccgacaagcattatcgcgtctgtcgatcgcgcctccggccact

SEQ ID NO: 2625 - DNA, 1000 bp, Picoa juniperi mycovirus 1
  isolate ANK_VIR-89, complete genome.1
gttctgctccccctgatgagctgggaccgaaataagctggacttatcggggtttagactgttgtccttccacacttcggtgaccaggatcgacatctgcttagatagccagatagtgcatgtgtgttcgagcatcgtttattcgattggctcagatgttcacaatcacttacaaccctatctatttgatcactaattccgtaccacccgtagcactaccgctaggtaagcgcagaacatcgaggttgtcccagttatgggcgtattggtaggggagtcactgttgtctatgacgcatcgaactcgtcccagcgatccattaccctagggaacctaactgcatgcgaaccatcaggttttaagctatacatgggtggtaggttatattaaatagaggtatcagtgctgaccgtctagtcctcagtatgacgttaaactactcaccgtctgtatcttgggacattaaactacaagtaggtattctagcgagcatgctgatccggcactcgtagaaaaggaggttcgcaaccttggaacatatctcgttccttaaccagtattgaataccattccatccgttgaccggggctatacggtccatcagtgtaattagtataatagcgagtaatggacatgcggtttaaacttggatgtagaataagtagataactgctttctattatggacgggctcacctactgtggttacgttgttctgaaacatgttggttctaaatcatgattggttcagtcttcttaagcacttacaaagtgaccgacccttccccataatatgttagatccaaacagttaatcgaagtatctcatcgacataacgattaaaaatcgtgtttaaacttagcataataaagttactttaagttatatgaacgcgcaggtattttgatagtttatcctaaatattaaactatctcggccggcttgttgtttgcggggctagaaatacgaagcaaggatcaccaaaaacttttttactcaatc

SEQ ID NO: 2626 - DNA, 1000 bp, Wenling crustacean virus 5
  strain WLJQ103138 hypothetical protein 11
aggtttgcacatttgcatcaagtcactcttgctctccacttgtgttaatccgattgattgttaggaaaactgaaatcgtccagtattcatccccctttgtaacatatcttgagtctctcttgagttccttagggcatatgtctctgacgtccagatacgggattagtagtgttttccctgaatctgagactaggcccggaatgggtagacctacaccttggtggatctcatatgcttgtcacgctactagctgtcttgccgttgagattggcgttttaaaagagaattcccaacccccaatttatccctacctatttagggcgatgtatttgtgaaagcttgcatcgccaccattttacacacctttttgattagcaaaaagaccacacatgaaatatcatcttgttgcactcctatgggtggttagtcttggactagcaatttgataattttcatcatacactatgtttacacattttactttgttcgtctacacatttatatgtttgttttcgttctgagagacatttagtgcagatttatttgcctctctaatacatgttattaacttttagtctgtatctttctcttctactatttatatttcctttatcttgttttagaattgacgctgtagagtggtctcattccccttcagcaagtcttttaagacatcctcctactatcgatgacgaaaattgtcccccaagagttaactagttaacgacactcttgggtactgaagttccgttcgattgtaagacctagaagcctgttttatgaatactatcttagataagaggcgttagaattagtcattgattagtttacaaataacgttagatgcaagtaggacctacttgtatactattttgttgtgaataatcaaagactctttgctaaaatctctcgactgttagtccatttcgtcgcggacaactaagataagatcatattacaatgctgaaatttaactaggcatgtagagcgcacataccgt

SEQ ID NO: 2627 - DNA, 1000 bp, Beihai picorna-like virus 52
  strain BHNXC41485 hypothetical protein1
taggtacttggaaggaatcagatgattagctagaaatgagtctgaccccgatagatttcgggacccaacacttgcgaacttatgctttaattcgcagcatgtagggaccgtggacttagtcttgtttgttctgagtgaacttacaattctttgctccccctcatgtaggaagaaagcaaaacgtagaggtacagtttctcctattaatgtacagaagaaacgaaaattctcaacgatggtattgactatgtcgaatccatgtccaactggatcaagttgggattttgatgggcttttagtttagccctttagtacagtaaaactacagcaaggtttgattagccttgagaagttcaattaatcacattgtttattagagaattaattattataaaactccagaaaaatatgtgtattattagtgtagagttagcatcactcattagaagatgccagttcgtttactgatcactcatccgaatagaaatagatatgagagaactatgtcctaattaaggatgcgtcaataaggtgctggagatgctggtagatggaaaattgtccgccagcgacggctatgcttgtataagctccctggtaaatcaagtgtagttacctcatctttgcagtacggaagtaaactgccgaatttctttcccagggtcgggaggggccctagcgggcacctcgtctgatctcaggactaaagccgcttgagacgacattctttttcaaatgcggatacccgtatcctcgtgagacctttgtcaattaagttcagttatttaacactgcgcgcattgatgatgaaactcaggaacggattctattcttggatcgtaagaaagtctgttttaaataacaatctcctggttaacggtgattaagcctggggtcgccttgtggttttcacaatccccccttggggtattgtgttccgcaaggctgatctttcaagtatcagccgtggaacattgtaccctcccactttcatgagaat

SEQ ID NO: 2628 - DNA, 1000 bp, Goji berry chlorosis virus
  isolate CY1, complete genome.1
ataataatggccatgttttagcttgtcaattttggttgaattgttgtgttgcaaataagattgccgttggactgtcatctgttcgttttaaaacacaaactgggagagatagtgtttttacgatgctaaagttttctggtgcgttgcagttttcaaagtatgaacgatttccaaatggtgcatcagtgagtcttaatacccctgctatctttgacacgttgtgtgctattgctgctgctgctgcttatagagatagacttttggagaaaacccatgggcataagatggataaaaggaaagataagattgtggaggacttttctactgctaattggtcttataatgattctagtactgcttatcacaagtctgtcgtgctactcaaatcacttttcagacaaaggtgtgttggtagaaataaatttgaacaatcttataatttaaaatgggtaccagctggcacaccaattttaacacttggtgatactcctacccttggttctcttaatcttgctttatctacttcttgtcttggactttggatggagggggcgtttctggttagtcaagacagattgactgatacttttaaatatggtgataacactttaatgtttccagtagatccttgggatactcctgttcactgtgatggatttctatatatccctaggaaaaatggaaattttgatgttgtaccgtataaatataagtgcagacagtttgtatttggagatatagattctaccattcgaggtaccagatctgatatgcttgctttcattgattctgcactacaattttataagtctaaggaaggagatgaaatcgaatgtcctggttggctcgatgttgtaaagaagatacttggtgacaaagccgccgaagaattacatgacacacacgataaggaggataaaactgttaaaccaccgttgggcgataaaacaactgaaattggtgaaacttctggtggtgtggacactgaatcataactgat

SEQ ID NO: 2629 - DNA, 1000 bp, Brejeira virus
  strain BrMS-MQ10 nonfunctional hypothetical protein1
ccgaaaccgaacttgactgtggatgcaaccaaaagttacttggcgttgcagaccattgtttatcacgaaaaacccatcaatgctatgttttgctccattttccgtgagataaaaactcgggtcacattgtccctaaagaaacatgttaagatcttttgtgatatgtcagctgaagattttgagaatgtgttgaacagagacatacgaccgagatcgttgtccccttttctcgagaagttggaaatagacattagcaagtatgacaaaagtcagagagaattggcgctcgaattcgagtgtaaattgatgtcgtattttggtgtcgacgcggatatcgttgaattgtggttcaatgctcacgtgttaaccgaagtgtatgacaaaaccacgaagatgagagctcttattccgtatcagaggaaatcgggtgacgcatcgacattcattgggaacaccttgttcttgatggctgtcgtgtgtgatctggtgcctgtatctgaacttgagcttgcattgttttcgggagacgattctctcctatatggtcacgatatggatgtttatcgtgattcgcaacatttcggtttgaagttcaatcttgaaattaagtttttctcttttgaaatgtcgtatttttgttcgaagtttctgttagttgtcaatgataaatggacgtttacgcccgacccagtcaaattcatgactaagctcggtcgacacgatctggttaatcctctacatgttgaggagtaccgtatctcattcgttgacactgttagaaattatcgcgattatcatgtatgcagaaacgtggcgaaggctttaattgagcgttatggaattgtgactgatcacacatcttttttgatgtctctggacgatatgacttcaagagaaaatttttctctgttgttttattcgttgtcaggtgataaaatcgactactctattactttcaataaagacttctaatctacgagattcgttcatataagttaaa

SEQ ID NO: 2630 - DNA, 1000 bp, Shahe heteroptera virus 2
  strain SHWC01c3694 hypothetical protein1
gcacatttttctgattgccctttctttgggcgtaactcgttggcgccatcgtgaacaaatttcgaccgacgtctgcctgctacgctttgaagagaaggtggcctcaattcaatgcttatattgcttcagcccgaaacgacatactcaggataagccctgtttattagtgggtcgttgtaatttgagatattgagttgtggtgtttaattgtctcaattaaactgtaaatatttttgttttcttttgttttgttcattttattagtacaatagttttatttttcttttgtttcatgccggtacctatccgcgtccgatgtgggaaagcacttcactagttgatcttagctttataaatctatcaagcggtattctagtgggctaggtacgtcttggtagtctcacttttgtgagtgcagtattaagcccggacctcgctcaggtgttgtcagtaaggggattcgtccttctgaaacttcgtaaggcgaaaagggaagtacggtttttgcaatagataggagaaatagcagtgtgcctttaaagtgctgcaaataaaataaaataaaaattttggtttaatacttcccgggactcatttagataaggcggtgtgcaggggtgacctcctatcggatcgaattatctccgactggaaagagagctgtaattgtaaacttcccgagggaacaggattatcgtgatcctggtgtgtaggcccattaacgttcgactgtcccaacttagcggcaggaaataagaaaaattcggcgttagtaaaacctatgatctttgtcccattcgagccaaagcatgtttatgttaggcttgacggttattgttgctataagaacctactgaagagatccccttccatcttttaaataaccagtaggtcgcagtatttcccctgggtgctctttggacttgtctgggggtttgggaaggcaactcatgcgcctccctcactctacgagcatactaataagcatggggccctcttc

SEQ ID NO: 2631 - DNA, 1000 bp, Manly virus
  segment 1 RNA-dependent RNA polymerase and glycoprotein1R
gacctctcttaaatccaaaccaagagatcaaaatttggccatagagaaattgtcgttttgcaatcaggaagtccgcatgaaaggatatgcaagaacctcagtggtcattcgcctttctgaccatggatgtgatccggcggtggctcttcaatatgtgctaaaagagaaagcagaggatttgatgttgggtgacggcctttccatcgataagaaggttcattggttactaacaaaacatgagcccgcacgaaagctccttggggcactttcggcatcagcctacaactagcacatgaaaaaaactaacagacctcactatgaggcgcatttttggtcgcttgctgcccgaagctccgaacatggctgttgttcctgcggcccaagcaggcccggtccgccgggtcaatgaccccctggagggatgggggcgacaattcgtgatggtccctcccgacccacaacccgttcccaacaccgtcaccagcaccacctatgacattgtaggtgagctggtggtgaacacacccctccagtccgacgatctcgtcctcctcggccagatggccatgaatttccctcactactatcaaggggatatcaccatgaaacctttccacaccgctgtgttctgcctgttagtgtcagaactcagatgtcggaccaccctcttccatggccgcattttcgccagtcgtgtggcggaatgtgtgaccttccagggagaacccagagagctcccccatggctcatctgccctgttcagagaaacgttcacctggcccctgcgaggagaaccttacgtctgggccgtgaacatctcttggactagatcctacatgccgggggtcgccctccatgagttcatccgtccccacgtcaaccccctcatgtcagccctaggcgtttccactcgttggaatggagtggataactacctggtcctcgtggcctagggtcccatttgcaatatggaccatgaaaaaaactaacagtcctcacc

SEQ ID NO: 2632 - DNA, 1000 bp, Wenzhou picorna-like virus 6
  strain WZSBei69574 hypothetical1
accactctcttcaacagagtgtactaatcacactttttacgtagtgagatttgaaactgtaatcgacagtcgcatacttataatctcaagtatgtagtaattgagtagtcctagaatttggattcaattttgaagaaaatccgccacgtggccaaggcgaaacttggcaagtgctaagcatggccgcacgttactgatcaaccacacgtggtagatccgcagccgagagagacggcacccggagtatttttgtttgtaattagatagattcattgagaacttatttccttcgcgccctgtaaaaagggaattggaatttactcagagcgtcaactgagtagtacgaccgcggtatggagcagcggtaatttagaccaatgatgttcttttatgaacatttataccagacatttctgatacataattgagagatggatactcaatcttgcagtaatgttccggctagtaggcaataacccaaaggcttgagggtcgcctgactagtataagaaaaatccacgaatggcgctggggagggttaatagcccccctagcatcaaatagcaatgaagttactaaaagcgtaaaaaccggacgaacccctatttccaattggagaaacacgaatcaaagatactgtcctacgtggactttgtccactaggatcagtgaaaaggtggaagatggacgttatgtgtacctcgaggatattctgttttcaaacaaatttttcgaggattcatacacagaaaggtgtattaaagatagtttcttaatcgataagagtgtaaatcgattgaggaagaaagaggcggaaaagcgctctcgtgattatcacagagcgtgtattaacccgtggctcgctgggaagaagcgagtcaagaaaagacacagtgatagtgaaaggcgttatcgtaggattttggaacaagttcgtgaacttacagatgtttcagttggttccaactgcaatgacgattcaattgactggtctgatgat

SEQ ID NO: 2633 - DNA, 1000 bp, Beihai picorna-like virus 41
  strain BHJJX25957 hypothetical protein1
attttctcgtacattttaagtttttgcgcgactttattgtcgcgtctttcacacgcatctagtgtgtgtgtgtgttatttttctaaataattgtttttcagtatgtttttagcatacgcttttcaattattatatgatgtctttgtatgactttattgttgtacatccttttgaatttttagtgcgattttatgttcgcacattgtgaccaggtttatacctggtcattttattcagcacgatctctgatatcgtgcagtaattctttatgtttgttagacataataatgtagtatggaattttgtaaaatttcgctcaaaagattgtttaagtgcattgtttgacatgtgtgagactcgagtactcgatgttatacaaatatgtactaagactttctttaagtgattgttataagatctctagctttctggaaacagttgactacgaagtcgtaataagcacattattcctaatataacatgaagtggggaattttaaccgctatacagtcgaatttactttcgattctgagtggctgaagtgatctttgtgaagctacccttcttgaaatcttacaataacctggaactcattggagttccggatactattggttttcgttgtgaaggatgcaagatcttagaaagaaattcagcagtcgctaacttacctgctcacgacgttgaggaggtagatttgactgtaatatgttaaaaggactaacagcattatacctattatagaaagtatcaataaaatccatttggtatggtaggtatgtgttccgctctaactaagcgtgccgagaggcagtctttgtttgaggaggcgttgttcccaccgtctccaagtatacgcccacgcgggagagtatgcaggtgaaacataattcggggtcttccatgaatatgggagttggaaatcgactgatcggtcgagcttctgtaaaaaacaaaatagatcgctcaacaacaaaaaacaaacaacaacaaacaaaat

SEQ ID NO: 2634 - DNA, 1000 bp, Guinardia delicatula RNA virus 01
  isolate GdelRNAV-01, complete1
agagagaagataaaagactccacacgggtattccccgtgtggagatcaataaacttttatcagtagtaacaatttgttactcaagtctgcgaatgacttttattaggtattcgaaactctttatatacaaccatgtctattaggggttttcccctaatagttatttgtttttctgagtttcaatgaattgttaataaatgttatttaaacatacttgtttaatgtattgaaaattctattgatgtgtttatgatcgaacccaagttttttcatctgtaatcgtttcacttttcgttaagaaatttgtcaagctggcgattacgtagtccttctggacgccaagcttatttatgaaccgaattggattataactggattatatggcattagtcttagttgtaattgttctttaacatttcgattccggtgaaccccggaatttgttcaggccttctggccacctcaaacgcttgcactcatgcatacagaagcgtttttaaaatatgtctgtacgatgtaatactgtaattacagaacttatcaaataaggaagaacctatattgatatttcatctcgttgtaatgcttagcgcttgcaataagagccccctcgtttatacggctgaaaatagtataaacctagtttaatatcacgctaagatcctgtgatattcttaggtaacctatcttatgatatggggaccgacccttagacaagactcattagtcggcgtattgtctaaacttatagttaggaagtaatgaccctaatttcacttgagaattcttgttggaaaactattaagttaaacctttaccaaccgatgtacttagtgtagcgcctctgcctgcggcgaataatacatgcttaaagtacgtaagtaagttcatcctcttaactgagtggtgaagcaaagcttttgtgtcgaagcacaattggattaccaattttgcgggctttcgcgaattggttcctctgtgcttgtcgctttcaaatttt

SEQ ID NO: 2635 - DNA, 1000 bp, Wenling picorna-like virus 1
  strain WLJQ101464 hypothetical protein1
aatcaacagcgatccttcggcatgaagtaaactgaccaaaatagaacctgatctaggtgtttttaagtcatggtaagtccatgagaccaaaaacaggcgttgctaacccgttacgaaaaagcggaaattattatcatagggatgatttgcaattcccaatggttcagactgcatatgtttgcggcatacacaaattcggttgtgtaacagctgtttattttgattctttgtctatagaaaatagacgaacttcctcctgtggcgcccggtaatagggtaggaggtacattgggcgtggaaccccagtgtgagtgtgaacgacttggagctgtgtcccactattgtgggtttagactctatttgttagtcattgaatcaattgaaccagcttgcctatgatcttacctatccacgtaggtattgcatggcaagtgctgtccttgttatagctgatgaaggcttgagtcagcttaacgttcgaggtaagtttgtagctctttaagagctagtgggaagacctggcgctgtcgtggattaatcgtcccttcagcatcaatatagcattgaagttagtaatagccaaaatcttttatccagaccatctttttcttcggatttagaattgcctttatggctttttaattgttggttgctacttaatgtagcaattagtgtgtacactattccccgtgattgtttcatttgggatattgtgtatggtgtgtttttcatttgtgtttttgtattgaccatctatttgtatgtttacagcattttattgatttggaaagctatatttggtccgcggcgtagaacttttgaagaacaacttggattcaggttaccgtcgtttgttacacctgattttgttgcacgggagaccactctgctattagcgttgaaaacgagtgtttcttcgagtcggaataaggcaggtgtcatatcagcgttggtatcttacgcacaagctcacagtcaacgttcccttttgggtcactta

SEQ ID NO: 2636 - DNA, 1000 bp, Wenzhou picorna-like virus 14
  strain WZSLuoII97619 hypothetical1
agggaatttatattccctacataccctatactttttagttgtaatctaaatgatgactctcttttgcagagaccctgtataaagatcgagatctgcgtctcgtgtttcagtcctaggattacactaggaggttagcacgggagcatgaaccatttattttgctcaagaaatttatacttttattcttttgtctggtttgctgaagccgaaatttcagcaccccctttttgcctgttatcaaacaggcccccgctttcgagcgggtgattggagactgtacaatcttgtgctgtctccatgctccggttttccggagccgcgatattatatcgcaaatcctcaaccgaggataatatcggttggtcccaatttttactcatttggataatgagtccctatttttgagtaggtgattgaagtgatagcacttcacctgcgcttccgagcgcactgctccctttgggagctgcagtatttatactgcaaacccccagccgagggttgtttcggctggttccattatattgatgtatctttaataattattttacatttgtttttgaattgcaaacggctcttctataacattcaaaagaaacccttgattcaaatgtttacatttgtaacttatgttttctgataccttatatactggtaaaatagaggattagcgtacctctcctcaagtagtttcagctcactctctttgagagaactgacgtccatattgtgatctagcttgattgatataagcggtaagtcaattaagcccattatgatatgttcggaaaattgtacacataatatacaggaagactatgtcctatggtgtgtacttcagtaagaccttagccggtcgcaattgttacgtgaataataggtagtcacgcgtaacacatttcacttgtggttgactcccacgagtgatcttatctttattgttactaaatttttacaacccgcttttgatcccgtcttcactgattttcgggattcaact

SEQ ID NO: 2637 - DNA, 1000 bp, Changjiang picorna-like virus 4
  strain CJLX29654 hypothetical1
ttttattcgcatcttgtagtgttcgcgagaaagaatctactatttagtgatcacaaacatattgggttgtttgtttgtgttcacccgaggtacgaaatgtaccagtcctgtttattaatactttggggataaaaagcagaattttctgcaccgtatacggtattgaaatgtatagtcgatattttaaggacattattaaatggacgtgaaagtctgttgaaactgctctgttttgaatattgctgtttgagggttgggaaaccctacttttgttgcgatggtagcaaatgcaccgtttagaccttatgacatttcgagtcactattggcttctgggaaggttgattaccagagtacgtgagcctagatctaacatgaggaggattgtgctggagcttgagaacatttggctagttgcgcatgttctgacaaaaacatcaatggggaaaggcgttaggccccacgtataagacagaagacacgttgttatcagaatttctttaaaccacatttatcacgtcaacccactccacattatttgtttagtttcccgtaaaccaatttttataggcgaacagccttttgatgtttattatgcagattttaaatttttaaataaagtagcgtatgtagttgtttcatattgttgtccagtagaaacactaatattgacattaaatgaatatgtaaacaccgaattaatagagttagaagagccattttatggcaattattttatagattgtaaacccattcgaagcggtttgaccgtttgtgcttatggggatattacaggtaagaaaattacaactaacattggccgtttatgcggaggttatcgtgatccttatcgcttgtatcatattattttgcaatgtgagaaacaagtattattagagaccttgaaacttcaaggtgatgaagagttcgcagaacaagttcgtcaagaacaatataaacaggtgcaacaagataaagtttttagaaacatattgcgtttt

SEQ ID NO: 2638 - DNA, 1000 bp, Alternaria tenuissima negative-stranded RNA virus 1
  isolate1R
gatccttccacggaagattacctcttcgccgccaaggttgatccgatggaactcgcagcttatgctggaattcttgcatatgcgattggcaagcagccgactgcggagaacatggatgcgttcaactctcgccggcgcaacgccatctcccaattccttcctgcaggcgatctcaagatcttcgttgatgattccgagttcttgtccatcgacatccttggcaagattcatcgtgcgttcaactccgtcacgatcgatcgagcccttgtcatgagtgcgattgtcgacaaggatgctgctctagttcagggacgcgagaaggtcttttacatcatcttccgtctcggatctggtgcctcgctcaatccattgctgatcatcacgcgctttgcgcgcaagtacccgtacttctattccgagtttcccgatctcgagaccgaataccatgccgcggctcatgcactccagcggttctttgatgttcccgagaagcgtcgcatgtacctcaaggtcatcttcgggagcgcctacgttcctgtcgatcgcacggatgtgaacgaacttctcggcgtctctgtctttgcacttcagcagtcagagccctcgcttgccaattacaacggcggaactctcagtgtcgtccatcgccagaagttgattcgcctcttggaggttgcttcaactaatgacgaagaaatccccgaggagcaacttgctgagtaagtgtttccaccactcatctccttattaaatccaaggatttaataaaacttaggagtaatcaataagatgaagctcgctgatgcacttcgactgtatgtcgaaatgttcgaactgattaccgcactcgtccaacgcgtcatggacgataagacattcgaagatactttcgacattgtctcacttgactaagttcacgtactcagttgcaagagttatttaataaaacttaggaaataacaaacgcatcgtctcgcactcaacctactcattaagaaat

SEQ ID NO: 2639 - DNA, 1000 bp, Ubei picorna-like virus 3
  strain WHCC101453 hypothetical protein 11
tcccagatgccatcgcgcatctcaacttgaatcctctacggtgaaaagccgtaccacatcagcctcgaccgataattaaagtaggtcatccgttttctacgaccaactggctgatgtgatgttcaacgtctacagccggtccatcatgagtatggacgtgcaaaacctgagtcgccacctttcgaagttggtgtgatagtcgtaggccgaccctgcctagcagttaataaataaactagcgtgagcctgcgataagggccaatcctcgggatgatctacaagtgattacccgcactgaagtcaacaaatttgattcgtttccacctgatctggagaaaccgatttgtaatggcttgcgccacggcgaagagtgaataactctgagtggctgccaccttgacattaagtgtgtgttctacacctgtattattaggacatgattatggtcctgtttatgttttctacaacctacgctgctaatcaacgctcatcgagcaccgcgtgcgattggagggactctgtttctctcctcttagtagtttgctatatatttatattgtctcgtatagacgtcaacccgcgtctctaaataaagctggataaaaagatgtattattcatattttcatatcacatcgtaccacatttatgaggggaaactctggaatggcattagccggtcagagtataaagaaccgtcagaggggatgtgcgagtttccagtcacattagtgatactggaccacattaccgcgccctggggacttagaggtacagtggtgtacgagaggtgtgtgttaggcgtagcctgcactcactttctcctctgcccaccgaggcctagtcatctttatacaatgcctagagaacaaccaaatgaattacagaacacgtgaaagtcgagttctaggtcggggcccctgaatgggtccctatcccagcgacggggagaaataatacgtttttaagaccaagtacgacataccatttaccgatttatc

SEQ ID NO: 2640 - DNA, 1000 bp, Thrips tabaci associated dsRNA virus 2
  isolate THR-E_DN239551
cacatcggtggcttgcgagggaactcactgcgctgcaggaaacacccaagtgcgttctcgcaaaagcaaatcaccaagcatccgtcggttgccgattggcaatcgctgggcctttatcccccctccctccttcgagcgggggggtaatgtgtgaatgtgataatgacggcttaggattcttaagccagagtgaatgtgatccgacttacggatttgggaaggcaagtgcgtccactgagcggttagaacgcctctgggcaaaggccgggctagtcccccggtaacacaactgcggttgttgcaaagataggtgcggtgcgcgaactctggctcctgttatacaggagtacagttacactcacgactctccctatcagagcacttgtcggctcaaatccgacatcggatgtatgatggctccccgagctaagcaactcgggttggggtgtgaagccgaaaggtcaccccgggccaatgcgtgggcggcatgaaactgccccatcggcaagtaagctgtgcatcatgccgatgagtgctggtcgaacctggggttggaccaacaaggaagaactccgtatgggcggggtgtggtacgtagaggaacttggagtgctgtactttcaggtaagcctggcaggaggactataaggatttagttcggcctgtggcctttggagggcagggcgtcttagcgcggcgagcaaggggtagtacaactaccgctcgtcgggcgggcgggtctaggtctatggctttaagtatagcaacaagaaatcgcgtgccacccttgttgcttcaatctcagaggcgaggactgcgcatgggcggtgtgggcacagcccacaccaccccacctctcagcggggggagggggcgtaaggggcgccctccctgcctagagcatcggatgcagccccccacttaaggaccagctacgactcattgatttattgattattgagtgtgaatatagtgcgattcagtgcgattattgtcctag

SEQ ID NO: 2641 - DNA, 1000 bp, Shuangao Insect Virus 5
  strain QSA09 polymerase (L) gene, complete1
atatgctatgttctcgcactcaactctatctcgcatcgcaggtgaagaattacctcgggtatgtagattgctccaacagatgatattagatccatactgtgcaatgttatccaatccgatccccgtgcgaacatatgcgaatatagcatacattgcctgtaaactcatatataaatctaatgttgttgccagtgacttgaccatgaaggtcactggatatgtgaacaccttacacacaatgatcacaatcgatcaagggttgttggatacagatgttatcaatatacgcgaatcacagatccaaatcagtggagatagagcttccttagtgaaggtgctggctaagcggcacgggtatcatataagttccgataaaaacaccatttttgagaaaattgaaccagaacctacatcttcagttcaatctacatcgcaatatgacatgctacctattaaaactcatgatatgatgattaatgacaagaagtatagagaaattgatattggagagaagtacaaggacatgaggacaaaagaagacatagcttttttcaacctgtgtcagcaattcaaaaatacaatgatgcaaacagtgattcctgacggcgcttcttatatccccggttccaaattgacacttactgaagatgagcataaatatctacacctcgataagtttaatgaagaaccaacggaatataaaagcactcaacacatcatcaccgataacatacgtaggtcaggttcggttttaatcagtgatattttgtcattagctaagggagttgggttgaattgggctactactgtagcgacgcctgtgatgcctgctgcttcttccacccgagcagttgttagaaccccggctgaagaggaggaaatgggcatttaataagtgtaaacaacgtgtatcaggtttttgatcatagcctcttaaaggatatgtggtgagattgcaagtgttttcctgattattttaaaaccaactctggtgtttacc

SEQ ID NO: 2642 - DNA, 1000 bp, Beihai picorna-like virus 22
  strain HOU126951 hypothetical protein1
attagactacccttcgaccatttgatttccatgctaatgcatgtactactcatatcgtgacaggataagagttaatatcgtaattaacgagaacccatcaatggaaattggccatcctctggtagaggcgtgtaaagaaccacgttagtgaaacggagtcgacattaggtccgtcaaccctgatatttgcgcacatgcttgtgtgcatatagcgaaatatgaatctacaagattgagccgaataaaaatattttgtagtgatccgtgttacggtaattttccgtctaagatttgtatgataccaggtatccgaaagctattgctggaggaccttgatgtaacatttatatgtagaccaacatactatcattccgatattatcgaacattaactataatataaattgtgaaactcgatgagctaggtgacacatttgtgtttaatcatctttgacatttgtcaactctgaggacgagaggagcagcggcacaattcatttgtgtaagaagcaattttgttaatagttattaatggtgtttgatcttgattcccttgggaaaggaattattgcatccacctaggatctatgcgtttggaaagtaaaggttgatattccatatcgtattgcccagtcacaattttgtggcccggtcggaacaggctaataccctgagctcggacttacatctgtaagtgaccggtatacctatcagttacgagtaccttcaaacctagtaaaccgctatattgcaacgaggaatttgttgataatcgtgtcctgagaactgatgctaacatcgttttggagggatacgaccctgagttggagtgccaggtaggcattggaagctttgtgagtattggaactggacttgatgtcctatccaaagcttcagggattgatataccagattggattgtcagtgagatagaatcaattatctgtttgtttatctctcttactggacaaacgactacgcaaggtgctttagccacaatt

SEQ ID NO: 2643 - DNA, 1000 bp, Fuchs virus
  isolate Antarctic41 non-structural polyprotein and1
gcaagcctatttggtactgtttcctcaagaatgaaattctgaaggaaaagaaggtcagtgagaatgacatccgagtgatatcttgtacagatcccgtctttgtgcgtataggagctgcgctggatgaacaccaaaatgctaggatgaaagcaaagacagagacgcatcatgctcaggtcggttggacaccctttaggggtggccttgacaggcgctgcaggcgcctcgcaaagaaggacgtatttgtcgagcttgattggacgcggtttgatggcaccattcctccttggctcttcagaagagtcagaatgatacgctggtatctcatgaatggagaagaccgcgagcgctatggagacctagcacggtggtacaccaagaacctgttgagtcggttcacgctgttcccaactggtgaggtcacactcatcaagaaaggaaatccttcgggtcagtattctaccactgtagacaacaacatggtgaatgaattccttactgctgctgagtttggctacctttataggaaggccaatggccgcctacccactgtcgaggagtaccgggcgagcgttgacatgctctgctacggagatgatagactccttggctttcgcgcggggttcgtcgactacgagccaaaggaagtcattgacttctacaagcgcgtcttcggaatgtgggtgaaagacgagaatatcaaggtggcgccctctcttgagggacttagtttctgtggttttacccttgtaagagtgaacggccggtactatggtacgatgcaggccgataagatcttgcagagcttgaagacccccacgaggtcattgcctgatgtggagtcgctttgggggaagcttatttcccttcgtatacttttacaccatagcgaccctaagcacaaggagtaccttgacaggcagattgccaaggtggaagagtacgcccgtgctgaaggtattgacctacccgaagtcgggcccgacttctataccaccat

SEQ ID NO: 2644 - DNA, 1000 bp, Fusariviridae sp.
  isolate H3_Rhizo_Litter_15_scaffold_561
tggtgctgaagagtgcttttgccgaaacgtcaagtacaccatgtatttattaaatactaggccttttgtatggctatataagttgtttttggtcttgatgttaattttgttattgacctcaggagtctgttttgcgtggcttggcgtaggctttgccgctgtgattttggtttttctcgccagtaatgctagccttgttggcatagcttttattggactgtttggaccttttgcacttatttattgtggcttcatctttgagcaagctgtgcgtcgtgaggcacagttgatcagggacgttggtgctgatacagctctgtgggcttttcttgataagaagcccattggtttcactatcttttcaaagctcacattgacacatgcagttttggcggggcatgataagtcaggccgacttttgtctgccagttttcgtgtcttgggcctaccacaagaaatacaagatatggtggaacctgggattcttactatggcttcaaggctctggtccaatcttgtgttgaatgttgactctttatatgatggcagagcatcatttatcgtgagtcttgctgcttattggtacttgcaacgaaaattttctgtttttctttggcgtaggtttgaaacctttgtcaaagttttgtggattgcatttattgtcttgtggtttgttaaaccacaacacttcctttttgccttaatgcaggtttttagaggtgttgtctttttctcaaaccgtgagcgtgtttctgtcttttcattgtggctcaagtggcgtctcacacatttaattgtgaagttgatagcatattttgagtctttcaatgcctcttttcggaaataccatagtgagcaactagacagtagcagaaagactctctctgcacattttagaaattttgtgatgtctgctgctgtttatatttctgatttgggcctaccttcttatgttcgtggtggtttcgtgccttacaataaggaaactttggaacaatca

SEQ ID NO: 2645 - DNA, 1000 bp, Beihai picorna-like virus 40
  strain BHNXC39087 hypothetical protein1
atggaatttccaaatacagacgacgcgatgttgtttcgttaacgcaatatatgtacttcgcagaggattcgcgtttcctcagcggcaaatacacagtagtgctgtgcgcgtaaccataatgggttacaacacgccgttttagtactgaatttatttgaagaatacaagaacttatacccaggcttgcggctaaaaccgtttgggtattcctcatattatgggtgcgctgaccctaatgaggagagtgatgtacgacttggagcagtattgcaatcatttgattgtatgagactgtattctgacaatattggaagactaatttatccggtctaagattgaaccctcccacatgttcgatgggagtggcgacttagatgcgtggcttgtttaactggtgcgaaagcttgagcaccgacctttcgagcaaagattatagaacgaaaaatggcgcctgaggtttgggttaacaaccccccaggcatcaataaagcatgaagtctctgaaagccaaactttgaatcagatttcactctctcttctccaagagagagctacctttatttcccgtcaaaacattgactctgttaaagagtcctgtcatgactattctttgaaattgaaagatttcttgagcgaaattgctcctggttttgaactaccggaacaattcgctttcttgaaggagcaaactatagcttctctgaacattctactcggtctagtgaaagatttatatgctgtcactaaagaccaccttgccgacattggatcggctctcatccatgttatcaatttttacattggaacacggaattctaccaactggacggatgtgtccattggttttgtgtcgttgtgtttgtccttattcaaattggataccattaaagattcagctaagtacgttcagcaaatcgttggtgtctttgtggacaagcttcgaacttattttgtgaagggcgaatctgccgagaaggagattcgttcgttttggtcggac

SEQ ID NO: 2646 - DNA, 1000 bp, Wenzhou tombus-like virus 6
  strain WZFSL85189 hypothetical protein2
cctcaaagccaatagctcagggacaatcaaattcggaccggatttatcggcatgtccagcgctttcaggcggaatactcaagtcctaccacgattacaagatcacagctcttacggtcgtctacaagtctttcgcgtcctcaaccacgtccggtgctatcagtattgaactcgacaattcgtgcacacaatcaaccctcggttcttatgttaactcattcaccgtctccaagacaggaaccaagaagttctcggcttcccagattaacgggaccaagttcatctcctcgacggtgaatcagttctatctgttgtacaagggttcaagtagttcaactgatacagccgggcaatttgtgatcactattagggttgtcaaccaaaaccctaaataggtagaagaccttccacctcaaccaactccaaccccaacgccgcaaccacagccagaaccacaaccgacaccgacaccagttccatcaaaacagttcttctgctgttacaccggaatccctattgtcaacatatcgactagggaaacgtctgactcaatatctgtaggtaagttatccacacagaccttcagatatacatctgatgaaaaatctgaagacagagacgttagatcttggtggtacagcaataacaatgtctctgcacaagcagctttcatatttcccgtcccaaaaggggagtacagtgctacagttgtttgtgaaggtttacaatctgtagaccacattggaggcacggaagatggacagtggatagggattatcgcttattctgatgattccactgacaactggggtattggtagatatcaagactgcacaatatcaaactaccaaaaccagtcgtcttggcggatagggcataaagacttgcaacttaatggctgtaagttcactggccaggctgttgagagagatgcattttgtacattccacatatcagcaacctccaacgacgccagtttctacattgttgcgcctaggacc

SEQ ID NO: 2647 - DNA, 1000 bp, Unknown
  Description of Unknown: Symbiodinium +ssRNA virus TR74740 c13_g1_i1 non-coding RNA gene,1 sequence
gccgagagggagattagaacaccgcgggctcgaacatcagtatagcgagtcattatgggaatgaaggtagtccgaccacggatatatcgcaagttaccgcgaacttcattttcttgtagggtgggcttccccgaaggtgtgaccttatggttcagtaggcgttcactgcactgaacgttgaagagctaggcgatgtactgacatctgcggaggcggttagcggttgtggtagtcgcgccgtccggtgagggccagagcaacatggagtagcgcccatgcgagtttgccagctcggacattttgttttgctcccccagacctgcatgcgcattctgaggcttggatcggcatggtcgaaggtgcgtggtggggtggttgcctgaagcaagtgtggttaagtgattctaggtattattccgtatgaatcttatgggaaggcggactcattgggttgagcctcgattcccatgccacaagcaacccagtgggaacggctacgggtgcgcttaaggtgcagcttggttatgtaagagcgagttaaaggagcggggttgtggcttgtccgtccccagaatccttcatcaagtccgcgacataacctgcaagtagcatgaattttgatgcattagtgcttaagcataaatggggtccactaactatattggtgagatgcgagtgtcattcgtttgggacaacttaacaaaacacttttgttttgatgaatgtgtggctatgcgtgttaatcctaatcaatttacgattattattccaagtgagtatgacttaccagccgatggaacaaccggggctggatatattcattctgttttgtttggtgaaatgcgtttttcatctattagacgattacgatatgcaagaaatcaagccatactaaccgttgacactatacccattcctcgtagtgaggaaagtgcttaaggcacaaattttggagtctagccgctgacaattttgttcatgcattcccaggtcataattt

SEQ ID NO: 2648 - DNA, 1000 bp, Hubei mosquito virus 4
  strain mosHB232766 hypothetical protein 1,1
aggaccccagatgtatccaataccgtaataagcggtatggtttacgtctggccacctacctacacccgcttgaaaaatatgtaatgtcctggacccgcaacggcactcacatctttgccaaggggaggaacatgaggcaacggggtagggatatcgcccacaaatttaacaggtacgaagagtgcgctgtggtctcccttgatcatagcaagtttgactgccatgttaatgaatccctattacgtgctgagcattggttttacaatcaatgctacggttcggaggagctggaatttttgcttgagctgcaggttcgcaacaaaggcatgactaagaatggcactaagtacactactagagccactcgtatgtcaggcgatcaaaacactggtctaggcaactgtttgatcaactatatgatgaccaagcagttgcttagtaagttggggatagggtacgatctgtacattgatggcgacgattttctaatcttcatggagaagagacacgtcccactcatcgacccgagtgcttattccgtcttcggtatgtcaacgaagttggagagtgttgcatacaccattgaacatgtggatttctgccagtgcaggcccgtattcgatggtgtgggttacaccatggtgcgcaaccccgagagaatgttagctagactaccctggatagtaggacctgtcgaggatagtcgagctaacgatattgtattctctactggacagtgtgagatcgctcaaggcttaggtctgcctattggccagtacatcggccagcgaatgtgtgagcgaggtgggaagatggttcgcatcagacatcgggcgtggttggagaaaatgaaacctggaaaactccaacctatagagcccatgggtggtgtgcgtgagagctatgaaagagcttggggtctgtcaatagccgaccaactgctaattgaacagactagtctggtggaacccgaggagcatttcgctccgggtattctaca

SEQ ID NO: 2649 - DNA, 1000 bp, Beihai tombus-like virus 10
  strain BHZY59908 hypothetical protein1
gcgtcgccaaaggccttaaccatagacaacgcgcccaattattaatcgataagttagcccgtttcgaagatccagtcatactttgtctggacgcccacaggtgggatgctcatttgaaaaagaggaagttagaggcagaacatctagtttatgtcctctgctccgctttttatgagctagctgaattgttgagaatgcagttgagcaacaagtgtcgaacccgcaatggcgttaaataccgtaccaaaggtaaacgcatgagcggtgatcttaacacagcacttggcaactgcctgatcaatattctaaccattctttgggtgtttatgggtattattatcgattttatggttgatggagatgatggaatagtcatcatggagcgcaaagattggattaagtttaaagatcaaattaacgaaaggtatggtaagactggattcgtcatgaaaatggaggtcgttgaccgattagaagatgttgaattttgcaaatcaagagttatacgtacacatttaggtcccagatttgtagtctatccaaagcatgtcctcagtgggagcacggttggtgtcaggccacggcatggtacttattgggttaagcgcatgcgagccgacgcgataggtctctacgccctataccaaggtgttccgattttgcaggactatgctctggctacactcgaagccacacagcaagtggtaccagcagaccttacaggagaggatgcatggtttcaatttagattgcatccagcgtataattatatggtaaatttgaaaaagattgacatcagtaagttagaccaattcatctcaccccaatctcgagttgatttcgaaagagcctttggaatatcaataggtcagcaaatgctaattgagcatcaattgagacaggcacataaagggtacctctgtgaggtcgcatatcttaagaaacatccttttctgttcacagtcgaacaaaccaggcatttattactcaaactttggta

SEQ ID NO: 2650 - DNA, 1000 bp, Riboviria sp.
  isolate bsk136shi04 genomic sequence.1
tccacaaagggggccaccctatcggaatccgcagccgggtggctaccagcccgaaaacaactatctgccggctgggcctgatgaccaggacagaccctacaactactatgcgccactgcgcgacatctttatgagaccacgcttacccaacctcttgggccccactatcaccatcgctgcttcggcagccatgaaggccatgccacacaacttggtctcaggggtcgtgaccacctatgccaccaaatatgcttataggagcatctggtccacagcctactatctagccggtaatgccctcattagtgtcagtcgcatagccacaattgctgctgctgtccgtggcttgacaccaacagccatgactgccagcattgcaatgagggcagcagactttggtggcaatctgttgcaacacgcagcgcgggtaactcatcctcgcgcaatgcatgtggcggccattgttgatggtaccatggccgctgccaacagacttgcctacccaatgctctgcatcggggctgtctggggactgtatgtcctggccaggcatgccatagagccaccaccatatgaggcaccacctggctgctatcccaatggtggccccatcgtggagattacgcaggaagaggcccccaatcgtgaaatggtctttacctgtccagcacccctcgcccggctagtccaagagagagtgctgctctgtgagagggacccaacaatcatccagaaggtcaaatcaattgcctcccgctggtgcgatgcagctggcatccaaggaaaccaacgctatgccgccatctgtggcgctgtagcctctgccttgaccgtaccagttaatgaacagctggtcttgcaactctcacagacacatgcagttcaaacacagtactcaagactagcacgctatctctctggcatcaaacacacccatgatgcctggtggactaagtacttctccatcaggcgctaggccaggtggagggatgctgactgc

SEQ ID NO: 2651 - DNA, 1000 bp, Sedov virus
  isolate Antarctic40 RNA-dependent RNA polymerase gene,1R
ttaaagacttctccatgcgaaacatcatatggcttattgaattctgctatactatgctatctaacatttatacaaaaactagaaaaatcatacgccgcttacttaaacgtctcacaacgagcacatgctcatccctcacagcgatactggcctgccttacgttattctgtcgcgaaattcatcagtatgttagcaatttccagcctggtaatacccctacaggtatacttcttaaccctgtcctactctgcattaaacacatggctgaattcatacacaaatctattccagctatattcccgtcggtttatgcctggatcaaccacgatccttatgtcagcgctatacaagattctctcatctccgaccatggaacaactattcaaactcagaactctcagctggatattaagtttgtacaacatcgcattggcgctgtatttcggattactacagaatcagataccaggtatgtatactgcggagatgaagtcacagcggatatccatatggctaagcgaggagcccgctatgctccagttgatggaactagtacctttgaatgcacatccgaccctgatgagacccttagtaaggttgatgagacctacattacgacaattgtaaacattgtggaagaaaaactgaaagacaatgagaaaattgcggaatttaccctagtacactttgtacaaacagtacaatctactggtacccgaattaggaagacacgagcagatatcagtcctgaatttatgagtaatggtgcctcttaccaaaatagtggcaaactttctatagacgttaatgtcgcaagacaaatggtaactcaaagagccactccaaacctggtccaatctcaccattacggttttctctaccttatggcctatgtatcaattaactccgagcaaagcgtaaattttcaaacacaaaaacagtcgattgcatcccggatttaaaaccccgaggcatatccacagtagtagtaaagaaatac

SEQ ID NO: 2652 - DNA, 1000 bp, Beihai weivirus-like virus 20
  strain BWBFG40173 RNA-dependent RNA1
attagcctaatacgtgaagtgtatgagccgggccctccggggtcgcgctcggcggcggtttaggtagaggtgggagcgcacggcccaactccctaggctgccccgagcaacaatacctgttggttttcgacacagagccttcagggtccacgtgtccggtgcgcgcctcggcgggcgcgcactgcaagacaggagtgccgccggcacgtggatgtgagaccgctccgtgcttattgctttgcgcggataggggtggcggcacggcgggcattgaggagcaagggccggtgctcctcattgccgcgtgccggcccgagccataccccgaaggttgccttatgcctgagtagccgagggtagttcggtgaacagcctggaagccgggtagcgccggtgacggtgagggcgccactgtttcccagcgcgtgggttggcctcttgggaggggggccgtaaaatggtggtttcgttgtgtgagtggtggctcgaaggacacaggcctgcgaggccggctctgcagtgttcgctgcgctgcaaccgggatatgtgggtactggtctggatgtttcgttcgcgtagcgcgcgcgggtgaataactgctggatggctgcacggcgggcattttgccgcgtgacggcttgaaggtggcgcacaacgacaaatggcatcgcgggggtgacggcccgcaacaacgcgcgtgcagggggacgccccccccattcgcacttcacgatgcatgtgggtatgtggacttagcgaatccgttgcagacccgttagctggtggcggcaccagctgaattcaccacattacaaaacaaaaatcgcaaaacgaaacttagcgacggggcaagccccggaagataaaaatagcataagtaaaacccaggcgtcctcctcaaggtgcatctgtgtcgcattctgacgcctggtcgttgtctccggctgccgccgggggttgaacgctgcgaagtgatttccgtattgctggtcgtgaaacg

SEQ ID NO: 2653 - DNA, 1000 bp, Beihai tombus-like virus 7
  strain BHBJDX18773 hypothetical protein1
aggaaaaggccttaataatgtgcagcgtgctttccaccttgaagccaaaatggcagacttcacccacccagtcgtctactctatcgacttgtcacgctttgaccaacatgtatcccgtgaactcctcgagattgaacactctgtctatctttcgtgcaatagcaatgactattttcgtaatcttctcaaggagcaattgaacaacttgtgctttacgcgcaatggatggggatataaagtgcgtggatgtcgcatgagtggtgatatgaatactgggttaggtaactgccttctcatgtacctcatgacaacgtcagctatgaggtaccttggcttagcaaagtatgagctctttgttgatggtgatgacacgctaataataattgaggaacatgatgagtggaagctttcgggcctcactcaagagttcctccgttatgggcatgaaatgaaactagaaaaccgtgcgacctcaatctccgaagtcacctggtgtcaggcaaaagtcgtatatgtcgatggcgtaccaaaatttgtggctaatcccactaaagtcctttcgacagctgtagctggggtgcgccattggcatgacaagggacgccaaaacatgggctattcccttggacaatgtcttttgtccttgtacgcgggtgtgcctatcctccaggctttctgtgaatctttaacatcacgaggtaggtggaatgatgaggtcatgtggcgcgactggatttatcggctaaccatcgaacaggcgaagaacgcaaaagttcgcgaggttagtatcgaaacccggttagctttccaacgcacgtggaaaattagccccgaggagcagatggctgtcgagcgccaactcctcgactgggatataactgcagatccagtatggtgccagtcacaagtgcgacagggttggttcatcgaccctgatattcgtgctggcccatgggcgcgcggtgggtatgacaacccactgacaacgttctagtccact

SEQ ID NO: 2654 - DNA, 1000 bp, Riboviria sp.
  isolate bpk205shi01 genomic sequence.1
gggtaggttagcatctgccaccatgatcgtgtgttaggcacgtaaaacctacgttgtcagtacggacatcgttaccaaaatcgtacggagtgacgtctccatctcagtcatccgtggctggacaaatagctaacaccttttcactgttactatggccacaactaccgattcaccgctactgcccgtcgggctcaacactcccaggttgtccacctggaaccgcgcactcattgccactaagaagtggtggcaaaatttgtgcgagaaatcggaagttacacagttgttgtgctgtgttgacgccactgaggccgacaattatcgtcgagacactcgtgtgcgatcagagattcgcgaagctatgcgctcgcagatgggcttttacggtcagcccacatgcattgcagcggtcatgcatgaaacaaagcaggagcataattatgctctgggagctgagcaggaggatgtcattcgtatgactgccgctcaatgggatgcactttttgtgcaataccgcttccatgcgaacacaccttcagcccaaattttggctgtggcgaagaaggtggttgcaccggcgcgtgttgtgccgaagtttgcagccgccgtcacgctccacatcaaggccaaactgggtgtgctcgccaagaccgaggcaaacctgctgcttgttcaacgcaagtatcttgaggtttgccgggaccaccgtgtgcgtgatgttgacgttgtgtcacacatgcagtttgtgcagaacgcatatttcacggaagatgtcctcgagcggctcgccaaaacgcgacttcgcgcacctgcgtggttacgccttttcgaagagaaggagcgtaccgccacgcttgaggtgtgctgagggcgcccggttcgggttcagggccagaacacaagtgtgtcaccacagcttcggttgaagcgtgacaccctgtgtgctggtaagttgtccgttcacaggaacgggctgctcgcaaaaccacgccaatttgtg

SEQ ID NO: 2655 - DNA, 1000 bp, Melipona quadrifasciata virus 2
  strain MqV2 nonstructural protein1
aaccgcaggaagatgatgtgtctgtagctgaattaaatacccacttttccaatatgatcaataagcatggtcggaaaggctacaaactatcattcgacgagggtcagaaacgagtcggattactcaaacgtcccatgaactgtacttggaacaaatttctcagtttgtggagacggcctgtctgcgtgatggataggtggtgttcaaaatactttgacgtatttcgtcttttcaataaacttgttatttttgatgtttatgagaagatagattctgataagtatactgtaatgttgaaacataagatgcgagcgaccaaatattgcagccgcgctgatgttcatgctgtcatcgatttcaaacatttcgaaaagatagtcgattgtcaacattttatctacaaagaatttgacgtagctactaagatgcttagggccgcacaaccaaatatttttgaactccaccaattcatggatgttgaaacagctgaggccgaattgacgatgaaagagagtaagttggaattagaattgttcatccaactcactcatattggtttacttgatagtacgatgacacctgaagatgcgcatagggcgatagtaaggaatgcaaaacgtttatgtactgttaactacaaccgataccgtcatttggtcacaaaccatcttcaagtgatgtcacttcattatgctaaggcatacttcaatcatcagttacttgaagttgtttcaactctggattttcaccgcgcctccccacaaacacgcgattctttgcgcttggttatcgctcacgggaaattagagagctttctgcacctattcaaacgaaaaacgggcttaagtttagaaatgttaggaacatcaactttcgtcctgttcgtggtgtggaaatggtttctacgggtcctcatgttgaggggtattgcttacctcatatcgacacaagagaccctgcttccctgtttgatggcgtgcgtgcacgtatggggaaagtg

SEQ ID NO: 2656 - DNA, 1000 bp, Changjiang tombus-like virus 12
  strain CJLX27860 hypothetical1
tcactactacgctttcgtttgtgtgggaacggttggggtcatattattcagcgaaagttctctgtttgtttaagcgagtttcgctgcatgcctcattacaatgaggtctacgctgtccagctttattccagctgcggccgctacatcatccaccttcgattcaggcttatagtcacgcagcgctcctctttggtagtgagtgttgtgcccatagccattcataccaccagggccacatgagtagtggcgcttctatagcgcttacatttctagtggtcatcctcatatttgcctgcgggtttttcattcagtggtgtctcatcaagcgcaactagtagccatggcaatttcttataagtttgtcgcgccgctggccattattccttgctattatgcgggacgctgggcgctcgtgaggtacggcaactcacatggctggtgggataccaagacagcttgctctgatgctgtcattggcattgccaccgccattgagcagcggtctgccggtagggacccctccgaccttctcagggcgttggagttcgacggggaggtcgctgacaatctgcacgaggagctggccgaggctgcgttctacgagcgaaagtcctacgagagccggcacttctaccgccactggattgcagccgttcgcatggagtttcctcttcggagtgatcgtccatccgataaggcctgcatgacaaagtggttggtgggcaagatgagggcaaagggcattcgcatcactcacattgaggatgctgtgccccggatcgtggcaatggccatcaaccccagccgtgctgaggttgaggctagggagatggccgaggctgccgatgcctggcgaaccccccccgcccttacgtgggtggagtggttgctaggcatgacgccgaagccgacttccgcgtcgaagtgggaatagtggtgccctgtggctgcgcctcagcgtgctggcgatgttggtggcattgcgcgccatctcgccgac

SEQ ID NO: 2657 - DNA, 1000 bp, Linepithema humile C virus 1
  hypothetical protein genes, complete1
tcccgtgtcaggcacccccagttttcggccttgaagcacaactgcatccccacattggatagcgcagacatatggcgaaatgctaagtacccatcgagtccgtttgacagttgcaatggcctggcacaacattgcccagtaaagtcatccttcccaggggctgctttaatacattcagattattatctgagttctgaggacttggcagccgtcatcaggtcgcacactttcatagtcacccacccatttgatggggaggaagggtgtttcaatgacgagttacattggaggaaagagggaccgtacatacgtgcgtggactgatgatggcacgccgtacaagcacttgtaccaccattgggaggctgaggggtgcataattgggagacatggagccgccacttacgtgagggtgcacagggggccgagcatggatgtgtactactgctttccatcaccaggcgtctaccgatcagacgacccgctcaggttgagaaggagtgacgaagtgctgatgcaccgattgcctagcgggaatttttattcagtgactaatggtagtgcgaagatctatgaccccgattttaaagtgttgcaagagataccgcatggcatcttacaacgagtggcagccaggtgtgggacagccgtccgtgatgagaagtttctaccggcgctggttgcttatacaacaacaaggttcacagcagacaaccaagacttgcatgtggtggaggatgtcatatcggtggccctgcggcatagcgacatgtttgccttgaatgtgtcttccaggtacattaccaatttcgatcccatgcgaatcaccaactttcagaggctggtgtgggtgtggaatgacttgcgctccagcttgagagggtattggaggttgcccctgacaactagcaacccactagtcaaccgtgtcactaccccttgggcatttagtcgtatatccgtcaacagttacgttcgtttcacccattatggactggtag

SEQ ID NO: 2658 - DNA, 1000 bp, Beihai mantis shrimp virus 6
  strain BHXG24422 RNA-dependent RNA1
accaaagtgcaagagttcgtttgtgcctcggagcaggtagtcgagggagactactcaaacttcgatggcagcgtgtccgcggatgctcagaagtgcgtgatgaacgccgtttatcacaggtatttccggagtgagttccaagaagaactcaccggctacaccagcatgctcatcacttgtcctgctaggtccaaaaccttcgggttcaagtatgacgctggtgtcggagtcaagagcggctccccaacaacctgtgacgcaaacaccgttctcaacgcctttctgcaatacatagccgtaagacggacactgccagagctctcaccagaagacgccttcctccaaataggattggcgttcggggatgactctctttgcaacagtcagttctccaaggcttggaccaaggcagccacccaactagggttcgcactaaaagtcgaaaagtgcgctcctgacacgggtgtgacattcctggcccgggtctacccagatgcgaaagcaagcctgacctccttccaggaccccgtgcgcacattacgcaaggcacaccttaccgggcgggacccaaatgtcccactcccggatgccgcgtgcgatcgcgccgagggttacctggtgaccgataaggagactccggtactgggtgaatacttccggttcgttttgcgccactatggaccgcaacggaccgcgaaggtgagagccgacagttgcagtgagaagccatactggctgacgcaaggcggaagctggccccaggaggcaaaggacttcgacttgatgctacactgcatggcagcacgcacaagcttcgaggtcgagaccttacgcgccatggaacttcactacaagagcgcgaaggacccctggacccccttaccttgggtgctgggagatgaggacccgacgcgggatacgcttaacgccgagggtctcccaagcacgggggcggtggactcacgtacatatgaaaaggacgtggagagagtaatccgtg

SEQ ID NO: 2659 - DNA, 1000 bp, Barns Ness breadcrumb sponge weivirus-like virus 2
  isolate H35,1
tgagtgtaaaaatgggaggcccgtcccagtccaccgaattaccttctttctcacacttcctcggtgtgggatatgagccaatttgcgggccgctgccgggcggctgaaggtgaaggccacgcccacgccacgacccgtggctattcggggcgcatcctgcatcctatcgggattaaaggttgaaggagcttccaagtaacccaacaggggctctggaacctagatgcagggtgggtgactacggcccgacgatcacggaatgagcacccgtgtgtcactcatttgcacggcaaggtgggcatgccaccgtgtagagtacgtcggttgggaacatgtcaagaggtggcttctcggctaagccgatggccagggttttagagcgcatgtatagaatgttgctagtgtttgctgtagtttttggtgtgttagaaatcttttgggttgcgtttgggtttgggtgtgcactccttcaaattaataggttacccctcgcctactgttgcaatcagcttcgttctcggtgagctcaacagcgactgtcaaccgacgcggtgtggtgagccgtcattggaggagtggtctcctttgattggcacgtactctagccaagaggtgcgactggtagaaggcatcgaacattgttaatcgtcctgtcttgtcattctcgtccatgacaagtttcgcatagaggccgtaatcagttcgattctttcctgggtgagctattcctgcgcttgtcggaataactctttgcggtggaagccacatcggtgagctcaaatgtgttttgggtcgcgacgcgggaagcggaggaggggccgaaaggccactcgtacgaagccaagggtattctgattgttgaggttgggtcgggcagcacccatcgccattcctcaatccacatgatttcacacacacactcacacagccacaacagcggcatgtattttcaagtgtccctcgcgcattgggtcttaggattttcggaacattcttcacc

SEQ ID NO: 2660 - DNA, 1000 bp, Barns Ness breadcrumb sponge weivirus-like virus 3
  isolate E6,1
gggggctggcgtgcgctagcgttgtcaaggacggcaagctggtgcgacagaagttattgcaattggatgagattgcacggggcgtggacatcactgatgaccacctttacgaccccgtgcagtatctgtccatgttcgagttgggcccattggagccgagcttctcgaacgtggcaggacggctctcaaaagctgttgagtacaacaatcgcgcaggcctcccgctcgaggatctgcgacaaaagcttattgagtgcgtgtcgagtgggcagaagtgtgcgaaagctcagggccaacccggtgcacaccattcccaggacaagggaaagggccggggagcgcttggacgcagcggtaagggggggcagacagccgcctcccaccactaggtggtcatagcctcctgttgcaaacacgcagtgcttcggcactcgcagcaggagggcgttggagcgtggggatcgccgtcggtgtgggaatccggcggtgacggcgtcagtcgtggggggttcggcccttatacgacaggctgatgtacgaagtaactggtggcttaggctaccaccagcgaaagaggcccgtggctgcggtcgcctcttttggctgcttggttgttgaccgaagtgagttgcgctactttggatgttgaatttagcctagtgcttcattcgacgccagttttgcgcgatttatcaacaatcgagttccccgaaccgacaccctgtgggtgctcagcttggaagcgggtcgtgatatatgattagcaaatacgcgggctatacttgagccgtccgtgatcactgcaacggataatgtcacgccgtggaaaggtgaaccacctatcacgttggtaagggtaacccggccgggatgggagcacattcaccatgtgcccggccactccatgtagctcaaaggcacagattaaccagctacaagcctaaaggaacctctcctgaacgcaccgctgtcgaacgacagctacaacgactttttcgct

SEQ ID NO: 2661 - DNA, 1000 bp, Filchner virus
  isolate Antarctic89 RNA-dependent RNA polymerase1R
tccttacaggatgggttaaaagcccttgaacctgttaaagctacatttttgcgtacgcgcaaacgtgatagtttcactgatgaggatacaatcataggttccccttacgggtcccatcaattgtctccttgtactgccagctttagtcgtgagactgtggctcgtgcacaagtgtatactattttaacagctgaacaggcaaaaatgaggcgttacttacttggtccagttacaaccgcatgggaacttgttcctttgtcttttgttgttgattgggtcgtacaagtaggcgattttatcgcttcatttcgtatgctccccaaagagtcacagggaataactttttctgtgaaagataaggtggaaattctagcggtcgctagtgcagactctaaactaatcatacgttcggacggttatattgtgtccagaattgatggtagacagagtttgagctactccaagcaacgttacacgcgcggggtaattccaaatgattttaaacatgaaatcccggttggcgttcaaatgaacctgtgtcgtactattgacgcattttctctcgcttataaaatcggactaagccaattaaaaaggagacattaacaatgtcacaatacaaaacgcgtactcgcggagaagccaaaactgtgcttgttaatccgtcaagctataaatcaacgcttgaggttatccacagtttcaaacgagacacagcccttaatcaggaccaagtccgaatcggtgttgcttcggcatatactgatgtagttaaaacctgcaaggactcctgtggcgtgccacgtcgcgagctggttaagcttgaaatgcctgttttattaggcatggacgaagcttattacaccagaaagaaacaacagctgactgacgttttagcgtcgggtcagaaacttctcgaagcattcgatgatgtgcagattggaatcattcctgatctgaacgtcgaagctactgtcgcttaacaataaggaatataatt

SEQ ID NO: 2662 - DNA, 328 bp, Picornaviridae sp.
  isolate ybw202shi02 genomic sequence.1
ttcgtccgaccactacatccaaccaacctcctcgcttgattggttgaagtatcatactgtccgtggtcccaaaaccttttacatcgagattctctcatcctgtgctagtgcccatttacttctaattactactcgaaaaccttcttacatcagcgagagcgccgactttgagacaccaacttgcgttgagctacccgctcctctagacgtctccattccccttcgagatcgtcttgttccgaagaaagcatatgacaatgcgtttgtctatgttcgtgctgttcgcacccttcgcaagactgatccagccggctttgttcgcacccag

SEQ ID NO: 2663 - DNA, 354 bp, Bat pegivirus
  isolate PDB-694 polyprotein gene, complete cds.1
acgacgcagtctcaccaatggactggcacggtccacaggagttgtcccttccggtgtgaataaggggccgtcacgagcggtgacgtaaaactgagggagattaggccagggtaacttggcgtgcgtacggccacgtcgcttctagatttcaatgccactcttgtggggcgagttgtcaaggccagcacggcggggcccccatactggttgggggtactcaatcgcctagtccagattatgccatgtttcccccaggcgggcgtagcgctacatgcggccaagaggaaaatccctatgggtgacctcgggggaaccttttcttttttagcggtcatggggtggtgtaccgcaacc

SEQ ID NO: 2664 - DNA, 365 bp, Pasivirus A3
  isolate CS15-4016, complete genome.4R
ccatcatcaaatatatacggagttttacgacacatacaacgacgcatgcgcaaccccacctacggttgcccgcgcatgcacagttgctgacatgcgcagtaaaaccaggaaatgactttgcattttcaagaaggtcacacgtaagcggatctctccgggtttttaaggctttttaagcatttttaccggatttttgacgtttaattattatctaaatgactcatctcatccctttaaatgtgctaacctgcaaggggacggtagagctgctttcctgcgactggtggaggtctgcgttggtttcacagtgggtaagtgagcctttttctgcctacttttatttctagacagattctgagtggctt

SEQ ID NO: 2665 - DNA, 383 bp, Rodent pestivirus
  isolate RtAp-PestV/JL2014 polyprotein gene,1
tgtataaggaaggggtgggagccttccctatacttgtttacaaataccatacagtgttacagcagtgtgtagtttactatgcaggtttgaagggcggggatagtctgtgccagcagacgtgtaccagcacttcagaaggaacctgcaactgcgaaccgggagagcatctagagcccctaagctgtgagtacacagcagccgtcagagagtcagctggaaaggatcacccacctggaagctctcgtggacggggtcatagaccaagggcaactctattgaggaggtggggtacctcttcatacaccccagtggtgtgatgtgctgcctgacagggtcccggctgatggcccggctagcagtataaaaatcagttgtaatggcac

SEQ ID NO: 2666 - DNA, 397 bp, Chicken proventriculitis virus
  isolate CPV/Korea/03 polyprotein1
gtaggttatatggagttcatgctcgttctgaaccgggaatggcacaacccgtagtaggatcttgcctctgccatattaatctgcgcctgttgcttctagactatgggctgctaaggatgatgttggaactcctttttggatattccatatcaagtcaactgtttcacctggtgtacgctggaaatccatgctttaagtcctcatccggaggtggtgctgaaatattgcaagccacggatgactcttgaagcctggtgccgctactaggtgttacaccctttatgggcaaatgttgaaccttagtggacgcgtgagatgggaatccacgcctggccatagactggctgataagctcgcggctgatcgagttgcaacagtaatcagttgatttgccact

SEQ ID NO: 2667 - DNA, 415 bp, Turdivirus 1
  strain 00356, complete genome.1
tcctcacccatgcttttcctacccccaccacgcccgcatgtttactgctttccttgatgctgcccgtgactacttccatgacctccccaacccaaacctcaaacgccttaagctatcatgggctctctatcaccaatccccttccttcccacccagaacccccccctccctcccctacaacgtgtatgagcaagacgagtttgacaagctcgccgaagccatgctcacccactctcccttccccacatcccattacctcttccaccccctcccgtccaacgcccgcaccatcgtcgagcgtgaggctgactgggatggctgtgatctagaaaagaaatggctcgacctcgtcatagaggacgatgccaagttccttctggagaacggctctctcccgtttggctccacccttgcc

SEQ ID NO: 2668 - DNA, 415 bp, Turdivirus 1
  strain 00805, complete genome.1
tcctcacccatgcttttcctacccccaccacgctcgcatgttcactgctttccttgatgctgcccgggactacttccatgacctccccaaccccaatctcaagcgtcttaagctgtcctgggccctttatcatcaatccccctccttccctcccaaaacccccccctcccttccctacaatgtgtatgagcaagacgagtttgacaagctcgccgaagccatgctcacccactctcccttccccacttcacactacctcttccaccccctcccctccaacgcccgcgccatcgtcgagcgtgaggccgactgggacggctgtgatctggaaaagaaatggctcgacctcgtcattgaggacgatgccaagttccttctagagaacggctccctcccgtttggttccacccttgcc

SEQ ID NO: 2669 - DNA, 425 bp, Duck picornavirus TW90A
  complete genome.1
cccccccccataccttttccccctctttaacggcaatggttaatggactaaggataaaggattatggacttatatgatgtgcccgacatggaattcgggaaatctggatctaagggttacctcaaaggtagtgaaattccctcgcaggggtatagtagctagctttgtgccttagtgaagggaccgtgtgttctagacatggtagttgtgtaggtacaagaggacttcatttgaatatcctcgatcccggacctaaattaccttgtggatttccggaggaatttaggaaaccacctccttcgggaggctagtaggagcttacatgactctcggattgggaagtccgagctggaccatgactgggtgatagcctgccggctggcgcagttcacatggtatagtcagttgaaaataaatagaaaatc

SEQ ID NO: 2670 - DNA, 430 bp, Picornaviridae sp.
  isolate cftwhg06pic2 genomic sequence.1
ccacccccctttcaacggctggcccacgatacgggccacaactttcctatcatcttctcatttcctataggttcggtttaatggttttgacttctgcattaataatggttttgtatgtggatgaccgtactatggatttggtgtgttaagctcacgttaaaaagctaggtggaatggatttgctacctggatggtcccccaggattaatggtaactccctctttcaccgaagtcaggaggaagagtagatgcttctagagttctgtgctctgtattacacagcaccgctcagctggcgtggacttccggccattggttgagttgacactaggagtagccagtactgggataactggcctggtctatactgctgataaggtgggttgcctgaccctctaaacctgactataattcaggctgtcttgatgcg

SEQ ID NO: 2671 - DNA, 461 bp, Turkey hepatitis virus
  2993D polyprotein gene, complete cds.1
ggcaagttgatatactggctctgatcacggactattctggtgttggtggacactctctccacaagtaggcgccgtggagttcatgctcgttctgaaccgggaatggcacaacccgtagtaggatcttgcctctgccacgtgcacctgcgcctgttgcttctagactatgggctgctaaggatgatcacagactcctttttggacaatctgtgtcaagtctactgttacatctgatgtacgctggaaatcctcgtactggaggcaatacctggaggtggtgctgaaatattgcaagccacaggtgtgtttctagtcttggtgccgctatcagatgtcgcaccctctacgggcaaatgtagaaccttagtggacgcgtgagatgggaatccacgcctggccatagactggctgataagctcgcggctgatcgagttgcaacagtaatcagttgatttgccact

SEQ ID NO: 2672 - DNA, 493 bp, Foot-and-mouth disease virus
  - type Asia 1, isolate1
cttgaggaatacttgtacaaacacgatctacgcaggtttccacaactgacacacacaccgtgcaatctgaaactccgcctggtctttccaggtctagaggggtgacactttgtactgtgcttgactccacgctcggtccactagcgagtgttagtaacaggactgttgtttcgtagcggagcatgatggccgtgggaactcccccttggtaacaaggacccacggggccgaaagccacgtcctaacggacccgtcatgtgtgcaaacccagcacggcaacttactgtgaaaaccactttaaggtgacactgatactggtactcaaccactggtgacaggctaaggatgcccttcaggtaccccgaggtaacacgcgacactcgggatctgagaaggggactggggcttctttaaaagcgcctagtttaaaaagcttctacgcctgaataggcgaccggaggccggcgcctttcctttaaactgttttaactta

SEQ ID NO: 2673 - DNA, 502 bp, Simian enterovirus J103
  isolate cg3697 polyprotein gene, complete1
aaaacgatcgttacccggctatctacttcgagaagcctagtaacaacattgaaactcttgagcgttgcgttcagcacagtaacccctgtgtagctttggctgatgagtctgggcactccccactggcgacagtggcccaggctgcgttggcggccaaccgatccgggcaaccgggtcggacgctcacttgtggacatggtgtgaagagcccattgagctagatagtagtcctccggcccctgaatgcggctaatcctaactccggagcaaacgcacgcaacccagcgtgtagtttgtcgtaacgcgcaagtctggagcggaaccgactactttgggtgtccgtgtttcctgttttaccttatttggctgcttatggtgacaatctagagttgttaccatatagctattggattggccatccggtgaatagatctcgatatattttattgcacagccttttatagcttgaattcataagtctcacttcaactcagaagtaatc

SEQ ID NO: 2674 - DNA, 506 bp, Foot-and-mouth disease virus
  - type SAT 2, isolate Buffalo 10 QE1
acgaaacgcgccgcctcttttggacttcttgtacaaacacgatcttgaagcaggaatcctcaactggcacacccgtgcaactgtaagtttcgcctggtctttccaggtctagagagatgagcagctgtactgagactaactccacaattggtctactagcgggtattagtaacactcactttgcttcgtagcggagcacatgagcgttgggaactcccccatggtaacatggacccaacgggccaaaagccacgcctcgtgcctcatgtgtgtgcaaccccagcacggcaatttgtttgtgaaacacaccttaaggtaacactgagattggtacttggtttctggaggcaggctaaggatgccctttaggtacccggaggtaacaagagacactctggatctgagaaggggaccggggcttctataaaagtgcccggtttaaaaagcttctacgcctgaacaggtgaccggaggccggcaccttttcccatctacaacttttatct

SEQ ID NO: 2675 - DNA, 507 bp, Foot-and-mouth disease virus
  - type SAT 2, isolate Buffalo 6 QE1
acgaaacgcgccgcctcttttggacttcttgtacaaacacgatcttgaagcaggaatcctcaactggcaaacccgtgcaactgcaagtttcgcctggtctttccaggtctagagagacaaacagatgtactgagactaactccacgattggtctactagcgggtattagtaacactcactttgcttcgtagcggagcacatgagcgctgggaactcccccatggtaacatggacccagcgggccaaaagccacgccttgtgcctcatgtgtgtgcaaccccagcacggcaacttgtttgtgaaccacaccttaaggtaacactgagactggtacttggtttctggagacaggctaaggatgcccttcaggtacccggaggtaacaagagacactctggatctgagaaggggaccgggacttctataaaagcgcccgttttaaaaagcttctatgcctgaataggtgaccggaggccggcaccttttctttttattaactttaaatct

SEQ ID NO: 2676 - DNA, 507 bp, Foot-and-mouth disease virus
  - type SAT 2, isolate Murchison Falls1
acgaaacgcgccgtcacttttggaacacttgtacaaacacgatctaatgcaggtttccttaactgacacacccgtgcaatttgaagtttcgcctggtctttccaggtctagagagacaacactttgtactgagactgactccacgattggtctactggcgggtgctagtaatgactttgttgcttcgtagcggagcatgcaagccacgggaactcctccttggtgacaaggacccgtggggccgaaagccacgttctctgaaccttgcatgtgtgcaaccccagcacggcaacactgttgtgaaacacactttaaggtaacactgagactggtacttggtttctggagacaggctaaggatgcccttcaggtacctcgaggtaacaagagacactcgagatctgagaaggggatcggggcttctgtaaaagcgcccggtttaaaaagcttctatgcctgaataggtgaccggaggccggcaccttttcctttaacactacttacttt

SEQ ID NO: 2677 - DNA, 508 bp, Foot-and-mouth disease virus
  - type O, strain O/KHO/IRN/L5/2010,1
acgaaacgcgccgtcgcttgaggaagatttgtacaaacacgatctatgcagacttccacaactgacacaaaccgtgcaacttgaagctccgcctggtctttccaggtctagaggggcgacactttgtactgtgcttgactccacgctcggtccactggcgagtgttagtaacagcactgttgtttcgtagcggagcatggtggccgtgggaacccctccttggtaacaaggacccacggggccgaaagccacgtcctaacggacccaccatgtgtgcaaccccagcacggcaacatttctgtgaaagctactttaaggtgacactgaaactggtactcaatcactggtgacaggctaaggatgcccttcaggtaccccgaggtaacaagcgacactcgggatctgagaaggggactgggacttctttaaaagtgcctagtttaaaaagcttctatgcctgaataggcgaccggaggccggcgcctttcctttaaactgtttcaactta

SEQ ID NO: 2678 - DNA, 512 bp, Foot-and-mouth disease virus
  - type Asia 1, isolate1
gcgcacgaaacgcgccgtcgcttgaggaatacctgtacaaacacgactcacgcaggtctccacaactgacacaaaccgtgcaacttgaaactccgcctggtctttccaggtctagaggggtgacactttgtactgtgcttgactccacgctcggtccactagcgagtgttagtaacagcactgttgcttcgtagcggagcatggtggccgtgggaacccctccttggcgacaaggacccacggggccgaaagccacgtccttgtggacccaccatgtgtgcaaccccagcacggcagctctactgtgaaaaccactttaaggtgacactgatactggtactcagacactggtgacaggctaaggatgcccttcaggtaccccgaggtaacacgcgacactcgggatctgagaaggggactgagacttctttaaaagtgcccagtttaaaaagcttctatgcctgaataggcgaccggaggccggcgcctttctccttaactaccacttctta

SEQ ID NO: 2679 - DNA, 514 bp, Foot-and-mouth disease virus
  - type O, isolate AMU_200, complete1
gcgcacgaaacgcgctgtcgcttgaggagaacttgcacaaacacgactcacgcttgtcttcacaactgacacaaaaccgtgcaacttgaagctccgcctggtctttccaggtctagaggggcaacactttgtactgtgattgactccacgctcggtccactggcgagtgcgagtagtggtgttgttgtttcgtagcggagcatgatggccgcgggaactcctccttggtaacaaggacccgcggggccgaaagccacgtcttaacggacccatcatgtgtgcaaccccagcacggcaaccacaccacgaaaaccacttcaaggtgacactgatactggtactcaaccactggtgacaggctaaggatgcccttcaggtaccccgaggtaacacgcgacactcgggatctgagaaggggactgggacttctttaaaagtgcccagtttaaaaagcttctatgcctgaataggcgaccggaggccggcgccttttccacaatttaatacttctttt

SEQ ID NO: 2680 - DNA, 516 bp, Bat pegivirus
  isolate PDB-303 polyprotein gene, complete cds.1
tcctttagaattaatggaacgctaggcttccggcccgaaagccgtggatctcccctgacagggttcttcgggtaaatcccggggggagtggtagcggtattagggtaggtcgtaaaaactgccccagtggggctacctagttgttaccggcaggacgaacggcgcgtcctgaaggactggcacggtccacaggtgtggtccctaccggtgtgaataaggggccgactcaagcggagtcgttaaactgaggctctagtgtcaagggtaacttgggcttgtgtacgtccacgtcgcttctagagttcaatgccagcactaggctggggcgagttgtcaagggcaacaggcgcgggggtggattattgttttccaccactcaatcgacactcgggtaatatgccatgctccctcccaggcgggcgtcgcgctgcaggcggcctagaggaaaaatccgaaaggtgacctcgggggggacctctcttctcttagcggtatgggtgtggtgttaccgcaacc

SEQ ID NO: 2681 - DNA, 520 bp, Goose megrivirus
  isolate HN56, complete genome.1
ttcgggacactggatgggcgactcggtggggctgccaccccgtcttgacttctcgttgttgaccctggaattctagaacattctcttgtcttctgcgtctggtccacggacggactaattggaatgtttattggttaagcctcgttctgaaatgccctagccaatgggctatagtaggatcttggtgtttccagtgaacctcttccgaccatagtagctagagttatggctgtgtaggatgtgggtaagaccgctttttgcgtatctcccacaagacaccggatcatgggtgtgtccgctggataaggctcgaaacctcccaactgacggtggtgctgaaatattgcaagcctaagttgtgtagaggcaagtagatgcccgccgcgacatctgtgatccgcccgtctgggttagtagtgtacctacatggacgtggggttgggaatccccacctagcataacactggttgatagacctgcggctggtcaagttactatggtataaccagttgaaatggct

SEQ ID NO: 2682 - DNA, 522 bp, Foot-and-mouth disease virus
  - type A, isolate 4235 polyprotein1
gggacgtctgcgcacgaaacgcgccgtcgcttgaggaagacttgtacaaacacgatctacgcaggtttccacaactgacacaaaccgtgcaacttgaagctccgcctggtctttccaggtctagaggggcgacactttgtactgtgcttgactccacgctcggtccactagcgggtgttagtaacagcactgttgcttcgtagcggagcatggtggccgtgggaacccctccttggcaacaaggacccacggggccgaaagccacgtcctaacggacccaccatgtgtgcgaccccagcacggcaactttactgtgaaaaccactttaaggtgacactgatactggtactcaaacactggtggcaggctaaggatgcccttcaggtaccccgaggtaacaagcgacactcgggatctgagaaggggactgggacttctttaaaagtgcccagtttaaaaagcttctatgcctgaataggtgaccggaggccggcacctttcttttaaaccacaactatcctt

SEQ ID NO: 2683 - DNA, 527 bp, Foot-and-mouth disease virus
  - type O, isolate O/K/52/19921
tttgagaaatgggacgtctgcgcacgaaacgcgccgtcgcttgaggagacttgtacaaacacgatctacgcaggtctccacaactgacacaaaatcgtgcaacttgaaactccgcctggtctttccaggtctagaggggtgacattttgtactgtgcttgactccacgctcggtccactggcgagtgttagtagtagtactgttgcttcgtagcggagcatggtggccgtgggaaccctccttggtaacaaggacccgcggggccgaaagccacgtcctaacggacccaccatgtgtgcaaccccagcacagcaattttactgtgaaaaccacttcaaggtgacactgatactggtactcaaacactggtaacaggctaaggatgcccttcaggtaccccgaggtaacacgcgacactcgggatctgagaaggggactgggacttctataaagtgcctggtttaaaaagcttctatgcctgaataggcgaccggaggccggcgccttttcactaaccactacttttt

SEQ ID NO: 2684 - DNA, 529 bp, Goose picornavirus 1
  strain goose/NLSZK2/HUN/2013, complete genome.1
ttctttgaaaagggtactgggggggtcgattctagacccccacctagcccttttccccgtcagtggggggcttactcactgggcatctgttaatctggcctaactagattgacaccactcccttggaacgtaactccacgctaactcactggctctacgcacagacacacggtctttctgctatccccggggaagataccagatggcgaccggctgtcccagcggcctagtagctactcgggttgagtacccaccacggttttgacgcctgctaaaattcaagagacagaggtaggggtgcttagtgtgtgggggaagttcccacaagcgaggcaaagcattgctccctcgcgtcaccgggtgcaaggtaaattggctggacttccgctctacccttgctactcgccctcttcggagggttcgaagtgacactaggtatacgcatggttgggaaaccatgcctggcctactactgggtgatagcctggcggcgggtccgtctcttggcttatacccgttgatttgggat

SEQ ID NO: 2685 - DNA, 529 bp, Foot-and-mouth disease virus
  - type O, isolate O/K/109/20001
tttgagaaatgggacgtctgcgcacgaaacgcgccgtcgcttgaggatgacttgtcaacacgatctacgcaggtatccacaactgacacaaaaccgtgcaatttgaagctccgcctggtctttccaggtctagaggggtaacactttgtactgtggttgactccacgctcggtccactagcgggtgctagtagtggtaccgttgcttcgtagcggagcatggtggccgtgggaattcctccttggtgacaaggacccacggggccgaaagccacgtcctgacggacccaccatgtgtgcaaccccagcacggcaactttaccacgaaaaccactttaaagtgacactgaaactggtactcaaccactggtgacaggctaaggatgcccttcaggtaccccgaggtaacacgcgacactcgggatctgagagggggaatgggactcctttaaagtgctcattttaaaaagcttctatgcctgattaggcgaccggaggtcggcgcctttccattaactatcactcactat

SEQ ID NO: 2686 - DNA, 532 bp, Foot-and-mouth disease virus
  - type O, isolate O/U/25/20061
ttgagaaaaggggcgtctgcgcacgaaacgcgccgtcgcttgaggatgacttgtacaaacacgatctacgcaggtatccacaactgacacagaaccgtgcaatttgaagctccgcctggtctttccaggtctagaggggtaacactttgtactgtgattgactccacgctcggtccactggctggtgctagtagtggtactgttgtttcgtagcggagcatggtggccgtgggaatccctccttggtgacaaggacccacggggccgaaagccacgtcctaacggacccaccatgtgtgcaaccccagcacggcaactttaccacgaaaaccactttaaggtgacactgaaactggtactcaaccactggtgacagactaaggatgcccttcaggtaccccgaggcaacaagcgacactcgggatctgagaaggggactggggcttctttaaaagcgcccagtttaaaaagcttctatgtctgtgtaggtgaccggaggccggcgcctttccatttaactattacccaccat

SEQ ID NO: 2687 - DNA, 550 bp, Foot-and-mouth disease virus
  SAT2/GHA/Tul/5/2018 gene for1
ttgtaaccgcacggtttgccttcctgggggaagtaaaacacccacaagcttgacagttttgcccgttttcacgagaaatgggacgtcagcgcacgtaacgcgccgccactttggaatacttgtacaaacacgatcttacgcaggtttcccaactggtacactcgtgcaacttggagtttcgcctggtctttccaggtctagagggacgacactttgtactgaaaccagctccacgattggtctactggcgggtgctagtaatgactgtgttgtttcgtagtggagcatacaagccgcgggaacccctccctggtaacagggacccgcggggccaaaagccacgttctttgaaccttgtatgtgtgcgaccccggcacggcaacactgttgtgaaacacatcttaaggtaacactgagactggtacctggtttctggagacaggctaaggatgccctccaggtaccctgaggtaacaagcgacactcaggatctgaggaggggactgggacttctataaaagtgtccagtttaaaaagcttctatgcctga

SEQ ID NO: 2688 - DNA, 555 bp, Picornaviridae sp.
  isolate zftwig06pic1 genomic sequence.1
ctgtgccttcctggtcataattggctccggctggttttgacttcggaacactggatgggcgattcggtggggctgccaccccttcttgctttttcggtgtgacattggaattctagacccttctttgtccctcgtgtctggtccacatacggactaaatggaatgtttgccagctaagcctcgttctgaaatgcccttgccactgggctgtagtaggatcttggtgtttctggtgaacctcttccgaccatggtagctagagctatggctgcgtaggatgtgagtaggaccactttttgtgtatccctcacaagacaccgggtagtgggtgtgtccgctggatatggctcgaaacctcccaactgaaggtggtgctgaaatatcgcaagcctaagttgtgtagaggaaagtagatgcttgccgcgacacttgcttcccacccttctctgggctagtagtgtacctgcgtggacgtggagttgggaatctccaccatgcatagcactggttgatagacctgcggctggtcaagttatcatggtataaccagttgta

SEQ ID NO: 2689 - DNA, 562 bp, Simian enterovirus 19
  isolate cg4006 polyprotein gene, partial cds.1
ccaccaacccaggtgggttttccgtcaagcacttctgtctccccggacttagtaccaataggctgtacccacggccgaaagggaaaacgttcgttacccggctacctacttcgagaagcctagtaacatcattgaatgtctcaagtgttacattcagcacaaccccagtgtagttcaggtcgatgagtcaccgaattccccacgggcgaccgtgtcggtggctgcgttggcggcctgcctgcgggtctcactcgcaggacgcttgattcatgacatggtgcgaagagcctattgagctaggtagtagtcctccggcccctgaatgcggctaatcccaaccacggagccatgcgctacaatccagtggtgttgtggtcgtaacgagtaattctgtggcggaaccgactactttgggtgtccgtgtttcctgttttatttaccttggctgcttatggtgacaatctagagttgtcatcatatagcgattggattggccatccggatatatcttttgtgtgatttacctcttgctaccaagcaattgtcacttgttaataatacc

SEQ ID NO: 2690 - DNA, 566 bp, Bat pegivirus
  isolate PDB-491.2 polyprotein gene, complete cds.1
cgtaggcgcctgggggttcgggtgcaagccccgaaaccgacccttacttcgaacaaccgttctagaacggctgggtcaactccccctttagtcaaaagcccagtgttgctggggtgccagggttcttagggtaaatcccggccccagtggatctgggaatatgataggaggagcggtgcggttcgaccaccgcacgggaccactgaccggcttgacgaagcggctagtagttgactagggcacggtccacaggtgtggcgtaccggtgtgaataacggcccgtctggagcgacagacgttaaactgaggggggtgtgaggatggcaacgcggcccgtgtacggggacgtcgctaaataccttcgggaacagctatgcgggttgtcaaccccagcggtggcgcggcctacctactgttggcaggtgccagttccctctcaccctcgcgaaagcagcacggggccccccagctggcgcagcgctacatgcggcaagaggaaaatccttcgggtgacctcggggggcatgtcccaaccaaacatgatactaggggtagcaactgccaag

SEQ ID NO: 2691 - DNA, 570 bp, Picornaviridae sp.
  isolate pst217pic01 genomic sequence.1
agatgtgtataacacacaggcccccttttcccgaccggtttggcacaccgggcggttaccctgattagatgtctgggaattgctggacttcagtggctattgctgctgtcttctggcttttctgaactgggcatctagttgggttctttgccatccacactctaattcccattacgttttctctaccccttgattggtctaactggttaagtgactccttgcctgcttttgactattcttggtgctggtggacactctttccacaagtagatggtatggagttcatgctcgttctgaaccgggaatggcacaacccgtagtaggatcttgcctctgccatactcatctgcgactgttacttctagaccataggctatataggatgatcttggacctctttttgagcatcctggtcaagccaactgtgtcttgcaacatgcacgctggaaatcctcgctagaatgaaatcctgatggaggtggtgctgaaatattgcaagccacatcggctttcattctcttggtgccgctgtgttgctacacaccccatgtgggcaaatgttggacctat

SEQ ID NO: 2692 - DNA, 579 bp, Murine kobuvirus 1
  isolate MKV1/NYC/2014/M014/0146, partial genome.1
gccaggtcgcatcgcctggttggtgaccaaactgctagatgctcctccctttccctcggggttggcgcaccgccatccctgcatcctccccccagcctgacatgctacaggctgtgcaagaaccccgcgaaagctgccaccgtggcaattgtgggtccccctcttgtcaaggcacagagtctttctcccttaaggctagacccctctgtgaattcagaggcggcaactagttgtgccactacatgcctcagacctcggtcgcggagtgctgttccccaaaccctgacactgccgcgtgagtatgctgcttggcaagcattgcctggatggtcgttccgctggggctgccaggtctggtaacagaccgctccagtgtgcgtagaccatctccagcttcggctggtgctcacaaggtaagactcggtgtaaggttcatgtgccaacaccctggaatgagtgaaaactctactgccctaggaatgctacgcaggtacccctgctcccttgggagccagggatctgagcgtaggctaattgtctgtcgggtagtttcatttcccaccctctagactgttcacc

SEQ ID NO: 2693 - DNA, 581 bp, Human rhinovirus A
  strain HRV-A43_p1224_sR3080_2008 polyprotein1
ttgtgtttgagtgttgtatactgttattacggtaaccttatacgccagttttatatcccccttaccccaatgtaacttagaagtttgtacataccgaccaacagtaagcaatcatccagattgtttaaggtcaagcacttctgttaccccggtcagcgttgatatgctccaacagggcaaaaacagcaatgatcgttatccgcaagatgcctacacagagcctagtagcactctagaagaattctggttggtcgctcagttgcaaacccagcaatagacctggcagatgaggctggacgttccccactggcgacagtggtccagcctgcgtggctgcctgcacactcctttggagtgtgaagccttaatttggacagggtgcgaagagccgcgtgtgctcatcttgagtcctccggcccctgaatgcggctaaccttaaacctgcagccattgtttgcaatccagcaaatatgtggtcgtaatgagtaattgcgggatgggaccgactactttgggtgtccgtgtttcttttatttccatttgtatgcttatggtgacaatatatgatatatattgacacc

SEQ ID NO: 2694 - DNA, 584 bp, Avihepatovirus A
  strain SH02 polyprotein mRNA, complete cds.1
ttcagctggtatggcatgcatgcatcgactgcttgggggtgtccctgacccccttaattcaacgtctagcccacgatacgggcaccctatccagtttatatccctttacctcccatggactgacttgtatggatttggatctaaattggattatcatttatttgtggtggttagccaaccatgctctggtgcaatgattccatgtattcatttggctaggtgccgacctaggaggtggtgctgaaatattgcaagccactggtgtcgttacttagcatctggatgcatggggttgattgcattctgtacagaggaaggctagcttatgccttgggctaatagtctttgttgtgaaacggattaccggtagtagcatcttagaccaccaaggttataggtgagtgtgtggtctagagtaggcacacatctgtccaggcacatgtacattgttacaactgctccagactagttcctgagggacagatgttgtggggggcttgggaaaacccccttaacctacactgcctgatcgggtcgcggctggtcgagtcccacacactataataccagtagaccttcatgca

SEQ ID NO: 2695 - DNA, 584 bp, Ljungan virus
  64-7855 polyprotein mRNA, complete cds.1
ggtcgaagccgcttggaataagactggtgctgttcacagtgtgttcacgatctatgcaacttctgtcttccatctgtgtctatgcaggtggataagggctgtacccgggcggtcctactctccacaggggcctgcgtaggtggctttcacctctggacagcgcaccccaccccgcctactgagtgaagggcatacggcttttctattgcgaattgtattgaagtttaggattaggtgtagcgaccacatgtgtgccagcggatctcccctggtggtaacaccagcctctgggcccaaaaggcatgtctctgaccacacatgtgcacaaccccagtgataatcctttttagtaaatgcttagtaacagtggattagcagtgctcctcaagctcagtagggcttaggtatggcaggttgaaggatgccctggaggtacccgcaggtaacgataagttcactgtggatctgaccaggggcccaccgggaattccccgggtagaagccttcgggccttgggttaaaaaacgtctagacctgtcccccagagggatctggggtttcccttttaaccccaattattcaat

SEQ ID NO: 2696 - DNA, 587 bp, Leveillula taurica associated picorna-like virus 1
  isolate1
caatagggtaacctattgtaacttggacttattactttatcatatagtttattgtttaaatcggaactagtgtattatgtttaaataatatgtgttagcctttaaactttattctattatttgataaggttcaataagtttgtatgactagatccagtaactattgctcaattttaaaacaatcttaaaaatctgtatgaaacgcagatcaatttaatattttagaactacccgtatttatataggctcttctaaaatatgaattgttatcgaaagataccttattattggttgattaatttcttaatgtgcatggtggcacctttaataagtagatttccgtcattctctatttagagtacttttggacgttaactaatgctccattcagtctagaatgtatgataattaaactctagattgtataaactatcattatcgcaagtaccacatcaaataaaacttatgaaaaaccgcaattactcgatgataactttgctcctgatgttagtgatattactaatactaactttctcgaggaaagggtagtcgaaactagggaagcatatccatcaacatctcttact

SEQ ID NO: 2697 - DNA, 591 bp, Feline sakobuvirus A
  isolate FFUP1, complete genome.1
tcacgcgcttttccggtggtcacccaccgttagggagcgccagcgttcgcgcttccgctaccaggtgacacactcctttcccctcccccattcccgttcccatcctctggactggtttctcctcacgattgaccagcagctgggagctgttaccagacgttggacagtaagtcccggatgcactatagggctggtggctagtgcttggtaagcactcaacgccatacctaatgtgtacctcggcttgccctcctggtcgtggtgaccggctgtttctcttcccttggctctagacgggctggtgtcctaccaccaccgttgcatgcagacctccccctgcgcactcgaacgccctgtcccagcagggttagtatgtgctgtgcagatctgcatgtgacaccccatccactggtagagcaggaagttgccctagctaacgcggcaagtattactttccgctacacgtccttgagattcctcggacctctggaactagggtgactgtgggcttgggaaaacccaccttggtcctgtactgcctgatagggtcgcggctggccgaccagtggatgtagccagttgttttgggat

SEQ ID NO: 2698 - DNA, 593 bp, Foot-and-mouth disease virus
  - type O, strain O/KAB/AFG/LI-709/2009,1
acgaaacgcgccgttgcttggggaaaacttgtacaaacacgatccatgcaggtttccacaactgacacacaacgtgcaacttgaaaccccgcctggtctttccaggtctagaggggtgacactttgtactgtgattgactccacgctcggtccactggcgggtgttagtaacaggactgttgtttcgtagcggagcatgatggccgtgggactccccccttggtaacaaggacccacggggccgaaagccacgtccagacggacccatcatgtgtgcgaccccagcacggcaactttactgtgaaaaccactttaaggtgacactgatactggtactcaaccactggtgacgggctaaggatgcccttcaggtacctcgaggtaacacgcgacactcgggatctgagaaggggactgggacttctttaaaagtgcccagtttaaaaagcttctatgcctggataggcgaccggaggccggcgccttttcttttaccactactaaatttatgaatacaactgactgttttatcgctctactgcacgcttttagagagattaaagcacttttttcgtacacggacacaaggcaag

SEQ ID NO: 2699 - DNA, 593 bp, Pacific black duck megrivirus
  isolate1
acgatggcgtgacgaaccatcgtgcgtgactctgctaagtcgtctgtgcctctcgggcatgttgtggctccggctgcaacatgcttgggacattggatgggcggcttggtggggcttagtcaccccgtttaggactacccggtttgatttctttattggattttgggactggtccaccgacggactaattggtatctgcaaggactaacagcctcgttctgaaatgccctagccaaagggacgtagtaggatcttggtgttccccttgtagctctgccgaccatattagctagagctaggactgtgtaggatgttctagacctctttttgagcaatctaggacaagactccggatctagatgtgtacgctggataaggctcgaacactcccgcgcgttaggtggtgctgaaatattgcaagccgacgtgtgtgtagagttagtagaagcccgccgctacatcgaaatccgccccttccggggttagtagagtacctgcatggatgtgtggttgggaatccacaccagtgcctagtgctggttgacagacccgcggctggtcgagttaatatggtataaccagttgatttggca

SEQ ID NO: 2700 - DNA, 610 bp, Human rhinovirus C
  isolate LZ269, complete genome.1
ttaaaactgggcatgggttgaccccacccatgccacccaagtggtgtagtgctcttgtatttcggtacatttgcacgccagtttgccaccccttaccccaagtaacttagaagcatgtaactttgatcaatagggagtggtaagccataccacttgagatcaagcacttctgtttccccggctctagaggaatagaccttgcaaagggttgaagccacgaaagtcgttatccgcacacatactacgcaaagcttagtatttccttgaaagctcgccggttggtcactccgttaataccccattaacagacctggcagatgaggcaggaaactccccactggcgacagtgttcctgcctgcgtggctgcctgcacaccctctcgggtgtgaagccgactagtggacaaggtgagaagagccccgtgtgctatgtgtgagtcctccggcccctgaatgcggctaatccaaccccacatctgtcgcacacaatccagtgtgtaggcagtcgtaacgggcaactgtgggacggaaccgactactttgggtgtccgtgtttcctttatttcttttatgaatgcttatggtgacaatatcgagtaatattgttacc

SEQ ID NO: 2701 - DNA, 611 bp, Rhinovirus C
  isolate 3430-MY-10, complete genome.1
ttaaaactgggttgtggttgttcccaccacaatcacctacgtggtgttgtagtcttgcatttcggtgcatttctatgccagttttatctccccagcccccgtaacttagaagaaaagaacacagaccaataggaggtggtcacccagaccacttacggtcaagcacttctgtttccccggttgatctagatatgctttacccgaggcaaaaactaaatcaatcgttatccgcaaagtgcctacgggaagcctagtagcactctgaaagcctatggctggtcgctccattgcaaacccagcaatagacctggcagatgaggctagacgtaccccaccagcgatggtggtctagcctgcgtggctgcctgcacaccctcatcgggtgtgaagccagaaagtggacagggtgtgaagagcctactgtgctcactttgagtcctccggcccctgaatgtggctaatcctaaccctgcagctgttgcacacaagccagtgtgtatgcagtcgtaacgagcaattgcgggatggaaccaactactttgggtgtccgtgtttctctttattccttatgttgacctatggtgacaagtgtgcaattcacgtttgtcact

SEQ ID NO: 2702 - DNA, 613 bp, Human rhinovirus A39
  strain ATCC VR-340, complete genome.1
ttaaaactggatctgggttgttcccacctagatcacctacagggtgtagtacactgttattacggtaactttgtacgccagttttatatcccctccccgatgtaacttagaagcaagcacaaacgtccaataggcggtgattatccaaatcacttacggacaagcacttctgtctccccggcaactgctgatatgctccaacagggcaaaaacagcggaagtcgtcatccgcaaaatgcctacgcaaagcctagtatcactctagaaggtgtgtggttggtcgctcagccgtgaacctgacggtagacctggcagatgaggctagaaataccccactggcgacagtgttctagcctgcgtggctgcctgcacaccctcacgggtgtgaagccattcattggacagggtgagaagagcccagtgtgctcattttgagtcctccggcccctgaatgtggctaaccttaaacctgcagccaatgcacacaacccagtgtgtatttggtcgtaacgagcaattgcgggatgggaccaactactttgggtgtccgtgtttctttttattcttatcatattgcctatggtgacaatatatactgttatatattgttatc

SEQ ID NO: 2703 - DNA, 615 bp, Porcine pegivirus
  strain ND/33/2017 polyprotein gene, complete cds.1
ccgctacccccccagcccgtgtaccggccctcgggccgcacgggatggggggggtagcgggggccggaggcccccgcgttctagaatggtgtgatcggttgccgctccagcggaaagcgggcgggatctagtggttagggttgttcgcgtaaatcccacactagtggtacgctcgtataacgtgggagcagccgggggggtcggccccccccctggcagctgctgagcaccggacgaagcgcggggggtgaacgctaacccgcagcccgggatgccaacgttaggcacgtcttggctggaagacgttaaacacagggccctccctcaaccccgatccgagaccagagttcaaggtacgccgcccttttaaaggcgttactcgtccaataggtctctccggcgggttgtcaaaccttgctggttccggtgacggttacgaggcagggcggggtggggatttaaacccccatccggcacgggggtaccaagctcggcacgcccagcacgcgtggcgtaggggaaaaatcctgcgggtgacccctggtaccataaagtaattaacatgagcatgccgctagggtgtgctttttccttccttgggaaggcggtggcacc

SEQ ID NO: 2704 - DNA, 615 bp, Human rhinovirus 45
  strain ATCC VR-1155, complete genome.1
ttaaaactgggtcgtggttgttcccaccacgactatctacggatgtagtgctcttgtattccggtacgcttgcacgccagttttgtcacccccccctacattgtaacttagaagattaacacaaagaccaataggcggcaatgaaccacattgtcaacggtcaagcacttctgtttccccggtcaatctagatatgctttaccaaaggcaaaaactggagcgatcgttatccgcaaggtgcctacgggaaacccagtagcattctttatttgatctggttggttgctcagccgttaaacccaaacggtaaacctggcagatgaggctggaagatccccaccagcgatggtgttccagcctgcgtggctgcctgcacacccgaaagggtgtgaagccttttcaaagacagggtgcgaagagtctactgtgctcaccttgattcctccggcccctgaatgtggctaatcctaaccccgtagctgtggtgtgcaatccagcacattcgcagtcgtaatgggtaactgcgggatggaaccaactactttgggtgtccgtgtttctctttttccttttatatatgcttatggtgacaattatacggatatagttgtcatc

SEQ ID NO: 2705 - DNA, 615 bp, Human rhinovirus C
  strain 024, complete genome.1
ttaaaactgggctcgggttgtacccacccgagctgcccatgtggcgtggtgctcttgtatcccggtacacttgcacgccagtttgcctctccttaccccgtaacatatctagaagaatgtgcataacggaccaataggtggtggcaacccatgccactgacggtcaagtacttctgtttccccggtgtgatgtggaatagactctctcagggttgaagccataagcatcgttatccgctacgtgcctacgcaaaacctagtagcattttgaagcttacttggttggccgctcagccactaacccgtggtaggcctggcagatgaggctgggcgcaccccactggcgacagtggcccagcctgcgtggctgcctgcccctctttgaggggaagccatttaagtgacaaggtgtgaagagtctcgtgtgctccacgtagaatccttccggcccctgaatgtggctaatcctaaccccgcagctattgcacacaatccagtgtgttgatagtcgtaatgggcaactgtgggatggaaccaactactttgggtgtccgtgtttcctgttttctttaaatacttgcttatggtgacaaatagtgtatactgtttgacacc

SEQ ID NO: 2706 - DNA, 616 bp, Equine pegivirus 1
  isolate C35 polyprotein gene, complete cds.1
gacgcgcatcccgggtgaaagccccgggcgtacgacctggttcgggatgattcccgttctcagtgcggaggccccgcaaaccgagccgccctgtaggcaacttctagaatggggagttaactcctggcactggcccgaagcatgaactgatcgcggtggcagggttcttcgggtaaatcccggccgcgtgttgtgattgtgttagggcaggtgacagtcggcagggtcgaccccctgcttcaggaccactgtcttcctggacgaccgttgctgaaaaagggccgccacggtctgtagctcgccgacgcttctaattcaggccggaggaccacgctccgtaatcgagcccaagtactcaaaccccagcacccctgggtcacgccctacgccgcccttttaacgcttcggctaatagggtctatccggcgggttgacaaagggcgcagggttacctggtactacgagcttgggtgtccctgggagtaatcccagggtgccatgctgcagcgcaggcgggcgagggtggtgcctcggcctaggggaagagcgcaagtgaccccgtgctgcataaatcccccccctttttttctacatgggtgttccatgtgccgccaag

SEQ ID NO: 2707 - DNA, 617 bp, Pegivirus K
  isolate PPgV_903/Ger/2013 polyprotein gene, complete1
ggctccccccccacctcgcgcggcccgagggccgatacgcgggttgggggggtagcgggggccggaggcccccgcgttctagaatggtgtgatccgtcgccgctccagcggaaagcgggcgggatctagtggttagggttgttcgcgtaaatcccacactagtggtacgctcgtataacgtgggagcagccgggggggtcgaccccccccctggcggctgctgagcaccggacgaagcgcggggggtgaacgctaacccgcggcccgggctgccaacgttaggcacgtcttggctggaagacgttaaacacagggccccccctcaaccctgatccgaggccagagaccaaggtacgccgcccttttaaaggcgttactcgtccaataggatctctccggcgggttgtcaaaccttgctggccctggtgatggttacgggagggggtggggcggggagtagaagccccgcccggcatgggggtaccaagctcggcacgcccagcacgcgtggcgtaggggaaaaatccttcgggtgacccctggtaccataaagtaattaacatgagcatgccgctagggtgtgctttttcttccttccttgggaaggcggtggcacc

SEQ ID NO: 2708 - DNA, 617 bp, Picornaviridae sp.
  isolate LoPV-1, complete genome.1
gccccgacgagtcccgtgggatacctggtacgtgccaggaaaatcccacgggactcgtcggggctttacccctaatttcaacgttggtccacgaaacggccgttctttcttttttcttctattttcaatcttgactccgcactgatcttttggttctagacacaggcgcgtttggttatagagtaggatttggatatagttatgagagggttagccaacccattctgaaccactttaagtatgtcaatctgaattcatcagtaatatagcacaggaggtggtgctgaaatattgcaagccactgttttatttatatgaagaattcaagaacctacttaaggtggtgatgaaaaggctaggtttatccatagtaatcccttgttctgaaaaggtaatgcacagtccttagtaggatcttgggctctgcaactggctctaaaccgaccaatctaggtagaggcactaggtgtaggacttgccatattgtattacaatctggtaccgacaaaatgtctggaaactccacactgagggtgataggggggggccccttcacagttgtgctactgcttgatagagttgcggctggtcaacttagattggtataaccagtagaa

SEQ ID NO: 2709 - DNA, 620 bp, Foot mouth disease virus
  A12; L, P2, and P3 polypeptide coding1
taccgcccatcccggtgttaaagggtgtaaccacaagatgcaccttcgtcccggaagtaaaacggcaatttcacacagttttgcccgttttcacgagaaacgggacgtctgcgcacgaaacgcctgtcgcttgaggaggacttgtacaaacacgatctaagcaggcctccccaactgacacaaaccgtgcaatttggaactccgcctggtctttcctggtctagaggggtgacactttgtactgtgtttggctccacgctcggtccactggcgagtgttagtaacagcaccgttgcttcgtagcggagcatgatggccgtgggaactcctccttggtaacaaggacccacggggccgaaagccacgtccaatcggacccatcatgtgtgcaaccccagcacagcaacttttctgcgaaactcacttcaaggtgacactgatactggtactcaaacactggtgacaggctaaggatgcccttcaggtaccccgaggtaacacgcgtcactcgggatctgagaaggggactggggcttctataaaagcgtccaggttaaaaagcttctatgcctgaataggtgaccggaggccggcaccttttctttacagccactgacttt

SEQ ID NO: 2710 - DNA, 622 bp, Human enterovirus C118
  strain PER161 polyprotein gene, complete1
ggacgtcagtacaccggcattgcggtgcccttgtatgcctgttttatattccccccctgtaactctagaagaaaatgaactctgagctcaacaggcgttacgtttccagcgtgactacgagcaagcacttctgtttccccggttgcgccctatatgctgtgtgaacggcagaaaggggcaaaatcgttatccgcttgactactgcgggacgcccagtatcaccatggattgatttgagagttgcgctcagcacatccccagtgtagcctgggccgatgaggctccgaattccccacgggcgaccgtgtcggagcctgcgttggcggcctaccctcgcctcacggtgagggacgctcacttcatgacatggtgcgaagagtctactgcgctagttaagattcctccggcccctgaatgtggctaatcctaaccactgatcctgtaagtacacgccagtgcccagcaggtcgtaatgcgcaagtcggtggcggaaccgactactttgggtgtccgtgtttcctttatttccttattgaatgtttatggtgacaattgttgagtacagttgttgccattattgcattctacaaacagtgaacaaaccacacaccaatatagcaca

SEQ ID NO: 2711 - DNA, 625 bp, Eotetranychus kankitus picorna-like virus
  strain EKPLV.abc9,1
cctattgagaagtgaactttcattttctatacaaagtgctatatttcgagcgacagtgtaaaactaaacaatagtgtacataacttattactcaaaatatagttaagacaaaagtcctctggaccccagtccagaggatctttgtcttaactatattttgagtaataagttatgtacactattgtttagttttacactgtcgctcgaaatatagcactttgtatagaaaatgaaagttcacttctcaataggagtatgtacttagtagattatataacagctgattattattggctgaaataatccgtaataatcgtaagtcgattatataagactacacgctcattttgtggttatttcaaatttaacaacttttgaaaccactttcattttaagatgtgtgttctatttatctagacgcatattcatattcacttgtttagtaatttcaccctactaaactcgtattcacgatacgtattttccagaattagtttactaatgagattatacgcattaacattttcgttagacttttgatacatacaaatctaacccttgtttggtaggcaagtacaacctactggtttcccgagacctatgaggggcccaataaatatgaaag

SEQ ID NO: 2712 - DNA, 625 bp, Coxsackievirus
  A16, strain CVA16/Homo sapiens/VNM/11.1/20141
gctctgcagatatcaatagcaggcatggcgcgccagtcatgtctagatcaagcacttctgtctccccggatcgagtatcaatagactgctagcgcggttgaaggagaaaacgtccgttacccggctaactacttcgagaaacttagtagcatcattgaagctgcggagtgtttcgctcagcactcccccagtgtagatcaggtcgatgagtcactgcactccccacgggcgaccgtggcagtgactgcgttggcggcctgcctatggggcaacccataggacgctctaaagtggacatggtgcgaagagtctattgagctagttagtagtcctccggcccctgaatgcggctaatcctaactgcggagcacatgccctcaacccagggggtggtgtgtcgtaacgggcaactctgcagcggaaccgactactttgggtgtccgtgtttctttttattcttatattggctgcttatggtgacaattgagagattgttaccatatagctattggattggccatccggtaaccaacagagctattgtttacctgtttgttggatacgtccctctcaatttcaaagtcattaaaactcttgattatatattactcctcaactgtgagaa

SEQ ID NO: 2713 - DNA, 627 bp, Duck hepatitis A virus 1
  isolate JX1405, complete genome.1
tatgaaagtaactggaaactgggaggatttcagggggaggtaaaaaaggtatgacaagggtgcatcgactgcttgggggtgtgcctgacccccctaattcaacgtctagcccacgatacgggcaccctatccaatttgtatccctttacctcctatggacagacttgtatggatttggatctaaattggattatcctttatttgtggtggttagccaaccatgctctggtgtaatgattccatctgttcatctggttaagtgccgacctaggaggtggtgctgaaatattgcaagccactagtatcgttacgcttggcctctggatacgtgggattaattgcattctgtacagaggaaggctagtctatgccttgggctaatggtctttgttgtgaaacggattaccggtagtagcatctcagactaccaaggttgtaggtgagtgtgtggtctagagtaggcacacatctgtccaggcacatgcacattgttgcgattgctccagactagttcctgagggacagatgttgtggggggcttgggaaaacccccttaacatacactgcctgatagggtcgcggctggtcgagttcccacacactataataccagtagattttcatgca

SEQ ID NO: 2714 - DNA, 630 bp, Duck hepatitis virus 1
  strain GHZ04, complete genome.1
ttttgaaagccgggtgcatgcatggccattttccagcacaggttcagctggtatggcatgcgtgcatcgactgcttgggggtgtccctgacccccttaattcaacgtctagcccacgatacgggcaccctatccaatttgtgtccctttacctcccatggattgacttgtattggatttggatctaaattggattaccctttgtttgtggtggttagccaaccatgctctggtgcaatggttccatgtgttcattctggccacgtgccaacctaggaggtggtgctgaaatatcgcaagccactagcgttattacacttggcctctggacacgtgggattaattgcattctgtacagaggaaggctagtctatgccttgggctaatggtcttcgttgtgaaacggattaccggtagtagcatcttagactaccaaggttgtaggtgagtgtgtggtctagagtaggcatacatctgtccaggcacatgtacattgctacgattgctccagactagttcctgagggacagatgttgtggggggcttgggaaaacccccttaacctacactgcctgatagggtcgcggctggtcgagtcccacacactataataccagtagattttcatgca

SEQ ID NO: 2715 - DNA, 633 bp, Rhinovirus B
  isolate BCH214, complete genome.1
ttaaaacagcgggtgggtatcccaccacccgacccactgggtgtggtacactggtactttgtacctttgtatgcctgtttgcatcccttttcccttcacctaacatcctcccccaaagtatattttgcggtaacgttagaagaagtgaactcagtgcaacaggaagtatcaccaccagtgatataacgcacaagcaattcttgttccccggagctggatatagactgctaacgtggtcaaaagtccttaaccgttatccgccagctaactgcgagaagactagtaacatcatgcacatttctagacgttcgatcaggtgaataccccattcactagtttggtcgatgaggctgagagttccccacaggtgactgtgtctcagcctgcgtggcggccaacccgacttatgtcgggacgcctattaatggacatggtgtgaagatcctattgcgcttagctgtgagtcctccggcccctgaatgcggctaaccttaaccccggagccttgtggtgcaaaccagcatttgcaaggtcgtaatgagcaattctgggatgggaccgactactttgggtgtccgtgtttcctttattcttattatttgtgtttcatggttacaagcatagtttgtaatc

SEQ ID NO: 2716 - DNA, 636 bp, Chicken megrivirus
  strain chicken/CHK-IV-CHV/2013/HUN, complete1
ttcccgaccggtctggcaaaccggacggttatcctggttagatgtctgatggttgctggaacgtggtggctattgctgccaccttctggcttcctttattgggcatctagctgggtcctttgccatattccatctaactctcttcccattttctattacccaggcttgttgtaactggtaagttgactcactggcttcgttttgagactactctggtgctggtggacactctttccacaagtggattgtatggagttcatgctcgttctgaaccgggaatggcacaacccgtagtaggatcttgcctctgccataccaatctgcgcctgttgcttctagactatgggctgctaaggatgatcttggaactcctttttggatattccggttcaagtcaactgtttcatctggtgcacgctggaaatcctcgtttctaggtcttgtctggaggtggtgctgaaatattgcaagccacggatggttcctaggacctggtgccgctatcagatggtacaccctctatgggcaaatgttgaaccttagtggacgcgtgagatgggaatccacgccggccatagactggctgataagctcgcggctgatcgagttgcaacagtaatcagttgatttgccact

SEQ ID NO: 2717 - DNA, 642 bp, Melegrivirus A
  complete genome.1
ttcccgaccggtctggcaaaccggacggttatcctggttagatgtctgatggttgctggaacgtggtggctattgctgccatcttctggctgcctttattgggcattctagctgggttctttgccaaaattcccatcttattcttattcccattttccttacccaggcttatttacaactggtaagttgacccactggttttgttcttggacttctctggtgttggtggacactctttccacaagtaagtattgtggagttcatgctcgttctgaaccgggaatggcacaacccgtagtaggatcttgcctctgccacatttacttgcgcctgttgcttctagactatgggctgctaaggatgaccgcagacccctttttgggcaatctgtgtcaagtctactgcttcgtctggtgtacgctggaaatccctgttctggatgcctatgcttggaggtggtgctgaaatattgcaagccacaagcatacctctggactcggtgccgctaccaggtgttgcaccccttgtgggcaaacgtagaaccttggtggacgcgtgagatgggaatccacgcctggccatagactggctgataagctcgcggctgatcgagttgcaacagtaatcagttgatttgccact

SEQ ID NO: 2718 - DNA, 643 bp, Turdivirus 3
  strain 00742, complete genome.1
gaaagggggcccggcggggcaatacccgtcggtccctctttccgtccaagccgcggacgttaaattgtggcacggttgtgcttaggcgcaaccctgctactaatggcggtatccctgcccttagtatgcatgtttgtatgaatggaatctgtagtgatgccccgctttggggtctcagaaacacactacagtgacggctagagttcctctactccggctaccttagtagcgagcattggaagtatattgtgaacagggttccacgcccgataaaggctgatattcccgctcatggagtggacctaggtaactagggccatgagtgtgtgtgaatcagcacccgcaagggataacagtatatggaaggtgctcgtgaaacggcaagtggagttagcagcagctctcagcctcaaggtcagcttctagacatgtgccgcaggtaccccgcaagggatctgagcggtagctaattagtccctggaagttggctgactttcttcttatttctttcttattgtgaattgtgtgcattggcattctttagagtttgggagttgtcttctattggatttatatcttactctgtatcacactcaatcacggctctttggtcagttaagaaaaccatttatagagtaataaa

SEQ ID NO: 2719 - DNA, 646 bp, Turdivirus 3
  strain 10878, complete genome.1
gaaagggggcccggcggggcaacacccgtcggtccctctttccgtccaagccgcggacgttaaactgtggcacggttgtgcctaggtgcaaccctgctactaatggcggtacccctgcccttagtatgcatgtttgtatgaatggaatctgtagtgatgccctgctttggggtctctaaaacacactacagtgatggctagagctcctctactccggctaccttagtagtgagcattggaagtatattgtgaacagggttccacgcccgataaaggctggtattcccgctcatggagtggacctaggtaactagggccatgagtgtgtgtgaatcagcacccgcaagggatagcagtatatggaaggtgctcgtgaaacggcaagtggagttagtagcagctctcagtctcaaggtcagcttctagacatgtgccgcaggtaccccgtaagggatctgagcggtagctaattagtccctggaggttggctgactttcttcctatttctcttttcactgcgaattgtgtggattggtattctttagagcttgggagttgtctcatattgaattcatatattttactctatactacactcaaacacggctctctggtcagttaagaaaatcatttatagaataataaa

SEQ ID NO: 2720 - DNA, 651 bp, Picornaviridae sp.
  isolate w3chi091pic1 genomic sequence.1
cggcctcttttcccgaccggtctggcaaaccggacggttatcctggttagatgtctgatgattgctggaacatggtggctatagctgccatcttttggctttctctattgggcatctagctgggttctttgctaatcttccatcttactcttatccccattttctattacccaggattgttcgtaactggtaagttgactaactggctatgttttctggctcttctggtgctggtggacactcttttccacaagtaggttatgtggagttcatgctcgttctgaaccgggaatggcacaacccgtagtaggatcttgcctctgccacatatacttgcgcctgttgcttctagactatgggctgctaaggatggctacggacctctttttgagtaatccgtgccaagtcaactgtttcactctgatgtacgctggaaatccttgttttggatgttatgtccggaggtggtgctgaaatattgcaagccacggacattcttctgaacctggtgccgctatcaggtgttacaccccttgagggcaaatgttgaaccttagtggacgcgtgagatgggaatccacgcctggccatagactggctgataagctcgcggctgatcgagttgcaacagtaatcagttgatttgccact

SEQ ID NO: 2721 - DNA, 652 bp, Duck hepatitis A virus 3
  strain DN2 from Viet Nam, complete genome.1
tttgaaagccgctgtggtgtagaccattttctggcgcttggctcagccagtatggtctcaccacagtctgcttggggttattcccaaaccccttaattcaacgcctagtcctatcaatataggaccccctatccacttattttacctttaccctccattatatagtctgtttcctggctattgactttggcttttgtttttgacctacgtctaagtctcaatggattttgtagtggttagcctaccaccccttggccactaatttttggctctctgtttggggacccaccacatcttggaggtggtgctgaaatattgcaagccacttgatatgtgtgtgtcctccagacatgaagctttgatgcagtggttttggacaaggaaaggctagtgtttggtctgggcacaaacccttgttgtgaaacggattaccggtagtagcatctagtggttccagtccataacatgagtgtatggtctagagtggacacagcttggatacagacaccttcagtattactgggtgttccagactagttcctgaggtaccaagttgtgaggggctatgggaaaacccctttgatccacactgcctgatagggtcgcggctggtcgagtcccatacactataataccagttgattttcatgca

SEQ ID NO: 2722 - DNA, 653 bp, Duck hepatitis virus 1
  strain 04G, complete genome.1
gaaagcggccactgtgtagccattttctagcgcttggtacagctagtatggttacacagtgtgcgtcagcttggggccattcccaggccccttaattcaacgcctagctctggcgatacagagccccctatccaattctatgtcccttatcctccacaggttgattgtctttcttgttctgactcaactgcctgttgtattggacttctattggattacccttttgtatggatggttagccaaccatgctctggttactagccattctatggcaggtttggcttgatactggtggatggaggtggtgctgaaatattgcaagccacgtctcccattgtcaatccaacccatcatggaatgtagttggtaattcctgtacagaggaaggttagtgtataagagtgggtctaataccattgttgtgaaacggattaccggtagtagcatccttggtatccattcttatcatgagtgtgtggtctagagtagacatgtattctcacaggtgcatgcagcattgctgagcactccagactagttcctgaggtgggaaatacatggggggcactgggaaaacccccttgatctacactgcctgatagggtcgcggctggtcgagtcccacacactataaaccagttgatttgcatgca

SEQ ID NO: 2723 - DNA, 654 bp, Sicinivirus sp.
  strain RS/BR/2015/7S polyprotein gene, complete1
tgcaacccccactagtactcgtgcacatccaatggtgattctgccctggcagcatctaagtgcccagggagctcaactggtaacagttgccctggggcccaaaaggctaggtggcaaggacctggtcaagtaaggggttcccaccccgagctgaacccgcggtcctgaagctaccctttagatggaggtttcgcacccgattgccattctttttgcctgaagaacctggctggaaacatttagcccacggatttgctggtttgtggtgattagtagaccccctggaggtacccgttttggatctgaccagggacccgtgactatgccgttccggtaatccgggtttaaaaccatgaacgtcaccacctatcttcttttccttgctttgaattcttttatctgagagtagtgaacgagtgttgatgttccctgacttttgcatttggtctgcattctcagttatacggtttgactgggctgggttgtttatttagatgtttctagagtctctgttggtagctattacacttgttatagtagttgcttcccccagtgagcttcatcagttatttactatttgtgtttataatttcgccttaatcttcctctggctggttgaaatcctagagcttcctaattaccctgccatccaac

SEQ ID NO: 2724 - DNA, 654 bp, Tupaia hepatovirus A
  isolate TN1, complete genome.1
gtttttcccggacccctctttggacaaccttggtggggggttgtaaattaccccaccctcgtttgcctagagtttaggctaaattccctatagtaccctttatatgtaaatatcaattcctgcaggttcaggtttcttgaatgtgtctctctttaagagcactcattttactctcagaatttctctagagtccagacacttgagggctctttttctcctgcactatcatctcgattccgggctctcgtggtgccaatggaacgaccgatgcgcacgtcggggttaacccacagattagctgtgggctgtagttgctaaaagccacgatctctgaatgccctctttgaatgggggtggtattaactgaacacatgaaaccacattgatcttgctgggagggtaggctacgggtgaaaccctccatattaatactcatattgagagatatatctggtaggctaatgttggcggataaggctgagtttcacgacaaaaagccttcaacgcctgtggaacaggtctcaccagcagcatgccttgtggcgtagtgtgctagggccatcttcatttcaggtgggagctaggagactctccccgtaagggttggaggggtagttcaggtgcatttaggtttttccacattcaataaaaaca

SEQ ID NO: 2725 - DNA, 657 bp, Chicken megrivirus
  strain RS/BR/2015/2R polyprotein gene, complete1
tttctgaaggcctcttttcccgaccggtttggcgcaccggacggtcatcctggttagatgtctgatggttgctggaacgtggtggctattgctgccaccttctggcttcctctattgggcatctagctgggtcctttgccacattccatctcactctttacccattttctattacccaggcttgattgtaactggtaagtttgacccactggcaatgttcttaagaccattctggtgttggtggacactctttccacaagtaggttacgtggagttcatgctcgttctgaaccgggaatggcacaacccgtagtaggatcttgcctctgccatgctaatctgcgcctgttgcttctagactatgggctgctaaggatgatgttgggactcctttttggatatctcatatcaagtcaactgtttcatctaatgtacgctggaaatccttgtctcagggttctatctggaggtggtgctgaaatattgcaagccacagatgaatcttgcggcatggtgccgctattggatgttacaccctttattgggcaaatgttgaaccttagtggacgcgtgagatgggaatccacgcctggccatagactggctgataagctcgcggctgatcgagttgcaacagtaatcagttgacttgccacc

SEQ ID NO: 2726 - DNA, 662 bp, Chicken megrivirus
  strain RS/BR/2015/3R polyprotein gene, complete1
gtgtgtttctgaagggcctcttttcccgaccggtttggcacaccggacggttatcctggttagatgtctgatggttgctggaacgtggtggctgttgctgccaccttttggcttcctctattgggcatctagctgggtcctttgccacatcccatcttattctttacccattttctactacccaggcttgcctgaaactggtaagttgacctattgaccatgtttttggactactcttggtgctggtggacactctttccacaagtaggttgcatggagttcatgctcgttctgaaccgggaatggcacaacccgtagtaggatcttgcctctgccatgttgatctgcgcctgttgcttctagactatgggctgctaaggatgatgttgagactcctttttggatatctcatatcaagtcaactgtttcatctggtgtacgctggagatccttgtcgtgaggctgtatctggaggtggtgctgaaatattgcaagccacagatcagtcttgtaacatggtgccgctatcaggtgttacaccctctactgggcaaatgttgaaccttagtggacgcgtgagatgggaatccacgcctggccatagactggctgataagctcgcggctgatcgagttgcaacagtaatcagttgatttgccact

SEQ ID NO: 2727 - DNA, 663 bp, Chicken picornavirus 4
  isolate 5C, complete genome.1
gggggctctcccccacggcctcttttcccgaccggtctggcaaaccggacggttatcctggttaggtgtccgatggatgctggaacggggtggctatagctgcctccttctggcttcctttattgggcattctagctgggccctttgccaaaattccatcttaatcttaaacccattttctatacccaggcttgcttgtaactggtaagttgacccactggcttgtcttaagactattctggtgttggtggacactccttccacaagtaagtattgtggagttcatgctcgttctgaaccgggaatggcacaccccgtagtaggatcttgcctctgccacatatacttgcgcctgttgcttctagactatgggctactaaggatgactacggacccctttttgggtaatctgtgtcaagtctactgtatcatctggtgtacgctggaaatccttgttctggaaactgcgtctggaggtggtgctgaaatattgcaagccacagatgcatttctggtcttggtgccgctactaggtgttacaccccctgtgggcaaatgtagaaccttggtggacgcgtgagatgggaatccacgcctggccatagactggctgataagctcgcggctgatcgagttgcaacagtaatcagttgatttgccact

SEQ ID NO: 2728 - DNA, 663 bp, Chicken megrivirus
  strain RS/BR/2015/5R polyprotein gene, complete1
gtgtgtttctgaaggcctcttttcccgaccggtttggcacaccggacggttatcctggttagatgtctgatggttgctggaacgtggtggctattgctgccaccttttggcttcctatattgggcatctagctgggtcctttgccacattccatcttactcttttacccactattctattacccaggcttgatcgtaaccggcaagtttgacccaccggctatgttctaagactattctggtgttggtggacactctctccacaagtagattgcatggagttcatgctcgttctgaaccgggaatggcacaacccgtagtaggatcttgcctctgccatgttgatctgcgcctgttgcttctagactatgggctgctaaggatgatgttgggactcctttttggatatctcatatcaagtcaactgttccatctgatgtacgctggaaatccttgtcccagggttgtatctggaggtggtgctgaaatattgcaagccacggattaaccttgcgacatggtgccgctatcaggtgttacaccctctatcgggcaaatgttgaaccttagtggacgcgtgagatgggaatccacgcctggccatagactggctgataagctcgcggctgatcgagttgcaacagtaatcagttgatttgccact

SEQ ID NO: 2729 - DNA, 664 bp, Picornaviridae sp.
  isolate phe068pic1 genomic sequence.1
agatgtagacatctaaccaggataaccgtccggtgtgccacaccggacggttatcctggttagatgtctgggaactgctggacttcagtggctattgctgctgacttctggctcttctgaactgggcatctagctgggtcctttgccacccataccctatctcccgttatattctctttgcccttggactgttgtaactggttaagagaccctccgcatgttttgtctatgactattctggtgctggtggacactctttccacaagtggatgatgtggagttcatgctcgttctgaaccgggaatggcacaacccgtagtaggatcttgcctctgccatactcatctgcgactgttacttctagaccataggctgtgtaggatgactatggacctctttttgagtatcctggtcaagccaactgtgtttataacacgtacgctggatatccttgttagggtggaatttcagtggaggtggtgctgaaatattgcaagccacattggattttaccctcttggtgccgctgtgttattacgcaccccttgtgggcaaatgttggacctacatggacacgtgtgatgggaatccacgtctctgctatggactggctgataagctcgcggctgatcgagttgtaacagtaatcagttgaaaagccact

SEQ ID NO: 2730 - DNA, 668 bp, Canine picornavirus
  strain 325F, complete genome.1
ttatttttcaaaatgccactggcattacaccatattcgtatggtgtaatgtcagtggttggatgcccagtcctgagggactgtgcatccagtggttaagagccacactctttatttatcaactattgatctttgtaactaagaaatgtaccagagttctattatggctccaaacccattggggtctagaacaagcacttctgttaccccggtcattattggctgttaggatgtacccacgtctgaaggccaagaagatcgttacccggctgttgtctacgggaagactagtaacttttgttgaaaggtaatctcattgatccgggtggcaaccccagtcacccagaaactagtgatgagtgtccacattcctcctatggtaacatagggtggtcgctgcgctggcactagggccttaaggcatgagagaaccaagacacaactgtgaagatccgactgtgcacttcagtattcctccggcccctgaatgcggctaatcctaacccacttgcacacgctcgcaacccagtgagtggtgtgtcgtaatgcgcaagaagtggacggaaccgactactttgggtgtccgtgtttctttttttatttaccaagtctcttatggtcacaagcattagaaacaagatgcctgtgatcactcgcgagacctccaac

SEQ ID NO: 2731 - DNA, 670 bp, Human rhinovirus A
  strain HRV-A76_p1194_sR844_2008 polyprotein1
cttcacacccgttaaggtgtgcaggcagccacgcaggctaggacactgttaccagtggggaactcctagcctcatcccacctggatctcctacaaggagttgtactctattattgcggtaattttgtacgccagttttatctcccctccccaatatgtaacttagaagctgaacacaaagaccaataggcgacatttaatccaaaatgtcaaaggtcaagcacttctgtttccccggctaaagctgatatgctccaacagggcaaaaacagttgcggtcgttatccgcaaagcaactacgcaaagcctagtatcaccttctagagcatatgactggtcgctccactataaacccaatagtagacctggcagatgaggctaggagttccccactggtaacagtgtcctagcctgcgtggctgcctgcacaccttaacgggtgtgaagccatatgtttgacaaggtgtgtgagccccgtgtgcttgctttgagtcctccggcccctgaatgtggctaaccttaaccctgcagctagtgcacacaatccagtgtgtggctagtcgtaatgagcaattgcgggacgggaccaactactttgggtgtccgtgtttcttgtttttccttatatttgcttatggtgacaatatatatataacatatatattggcatc

SEQ ID NO: 2732 - DNA, 671 bp, Picornaviridae sp.
  isolate wbp226pic1 genomic sequence.1
gccgcaggggataacccctgcggaccccttttcccgaccggcttggcaaaccggacggttatcctggttagatgtctgggatttgctggactttagtggctatcgctgctatcttctggcttctctaaactgggcatctagctgggtcctttgccatccaattctttattcccatctatttttccacccatggactgatgtaactggctaagaaatcctctggttctcactttggccacgcacttgtgttggcggacactctttccgcaagtgaacagtgtggagttcatgctcgttctgaaccgggaatggcacaacccgtagtaggatcttgcctctgccacatcctgtttgcgactgttacttctagaccataggctgtgtaggatgactttggacctctttttgagtatccttgtcaagctaactgcaattacaacatgtacgctggaaatccttgtctgaaagtagatcctagtggaggtggtgctgaaatattgcaagccacactagattctctttccttggtgccgctgtgttgctttgcacccctagtgggcaaatgttagacctacatggacacgtgtgatgggaatccacgtcttggctatggactggctgataagcccgcggctgatcgagttgtaacagtaatcagttgaattgccacc

SEQ ID NO: 2733 - DNA, 672 bp, Foot-and-mouth disease virus
  A gene for L, VP4, VP2, VP3, VP1, 2A,1
ccccccctaagttctaccgtcgttcccgacgtaaagggatgtaaccacaagcttaccgcctttcccggcgttaaagggatgtaaccacaacgacttaccttcacccggaagtaaaacggcaacttcacacagttttgcccgttttcatgagaaacgggacgtctgcgcacgaaacgcgccgtcgcttgaggacttgtacaaacacgatctaagcaggtttccccaactgacacaaaccgtgcaatttgaaactccgcctgggctttccaggtctagaggggtgacactttgtactgtgtttgactccacgctcgatccactggcgagtgttagtaacaacactgctgcttcgtagcggagcatgacggccgtgggaccccccccttggtaacaaggacccacggggccaaaagccacgtccgaatggacccgtcatgtgtgcaaacccagcacagtacctttgttgtgaaactcactttaaagtgacattgatactggtactcaagcactggtgacaggctaaggatgcccttcaggtaccccgaggtaacacgtgacactcgggatctgagaaggggaccggggcttctataaaagcgcccggtttaaaaagcttctatgtctgaataggtgaccggaggcaggcacctttcttttaattacactggactt

SEQ ID NO: 2734 - DNA, 673 bp, Rhinovirus C
  strain 20692_39_HRV-C polyprotein gene, complete cds.1
ggcgcacaggtttccaagcagagtgtgggagcacatgaaaccatggtacaggaataaaaggaaacacggacacccaaagtagttgttcccactataaccacccacgtggtgttgtggacttgtatttcggtacacttccatgccagttttatctccccccctgcaacctttagaagacacgtactttcagaccaataggtggcggccatccaggtcgtcgacggtcaagcacttctgtctccccggtggtactggatacgctttacccaaggcgaaaaccgggcccatcgttatccgcaaagtgcctacgagaagcctattagcactctagaagcctatggttggtcgctccgctgcaaccccagcagtagacctggcagatggggctagacataccccaccagcgatggtggtctagcccgcgtggctgcctgcacaccctatgggtgtgaagccagaaagtggacagggtgtgaagagcctattgtgctcactttgagtcctccggcccctgaatgtggctaatcctaaccctgcagccgttgcacacagcccagtgtgtatgcggtcgtaacgagtaattgcgggatggaaccaactactttgggtgtccgtgtttccttttattcctttacttgcttatggtgacactgtatagttatacattgtcact

SEQ ID NO: 2735 - DNA, 675 bp, Foot-and-mouth disease virus
  - type O, strain HLJOC12/03 polyprotein1
aaccacaagtcttgcaccttcttgtccgaagttaaaggactgtaaccgcaagctttgaaccgcctttcccggcgttaaagggctgtgaccgcaagatagaccttcacccggaagtaaaacggcaactcccacagttttgcccgttttcatgagaaatgggacgtcagcgcgcgaaacgcgcagtcgcttgaggaggacttgtacaaacacgattcacgcaggttcccacaaccgacacaaaacgtgcaacttggaatcccgcctggtctttccaggtctagaggggtgacactttgtactgtgattgacaccacgctcggtccactggcgagtgttagtagtagtattgttgtttcgtagcggagcatggtggccgtgggaccccctccttggtaacaaggacccacggggccgaaagccacgtctcaggacccaccatgtgtgcaaccccagcacggcaaccttaccacgaaaaccactttaaggtgacactgaaactggtactcaaccactggtgacaggctaaggatgcccttcaggtaccccgaggtaacacgcgacactcgggatctgagaaggggactggggcctctgtaaaagcgcccagtttaaaaagcttctatgcctgaataggcgaccggaggccggcgcctttccttaactaccactgtttac

SEQ ID NO: 2736 - DNA, 675 bp, Parechovirus A
  isolate HPeV-16/CMRHP2/CMR/2014 polyprotein gene,1
cgtcgggccttataccccgacttgctgagcttctctaggagagtccctttcccagccctgaggcggctggtcaataaaagcctcaattgtaacaaacatctaagcttattacatataaccacaaccctggtccccaccagcttaaggcatcttgcaatacagtgggtggactcaggacgcttaaaggttgtagtacataatcttttctaatccaactatgttggagtggtggacagcgcaccataactctatcagtgagataccatgcttgtggaccttatgctcacacagctgtcctctagtcactaagtgtggaaactaatgaaatgtgggaacttagttgaagtacacacttgcttatgcaccaattagccagcggatcaacacccggcaacgggtgcccctggggccaaaagccaaggtttaacagaccctaattggttggttttaaaacctgagcgtgtacggatgctacttagtacctgtggatttggtaactgtgcttatactagttgtaaggccctcgaaggatgcccagaaggtacctgtaggtaacaagtgacactatagatctgatctggggccccatacttctctaaagtgatggggttaaaaaacgtctagagggccaaacccaggggggaccctggattccttttattttatttagacaat

SEQ ID NO: 2737 - DNA, 678 bp, Foot-and-mouth disease virus
  polyprotein precursor, mRNA, complete1
actagtgattttaccgtcgttccccgacgtttgaagggaggaaaccacacgcttgcagcaccactcccggtgtcaacgggatgcaaccgcaagatggaccttcgcccggaagtaaaacggcagctttacacagttttgcccgttttcgtgagaaacgggacgtccgcgcacgaaacgcgccgtcgcttgaggaacacttgtacaaacacgatttaagcaggtttccacaactgataaaactcgtgcaacttgaaaccccgcctggtctttccaggtctagaggggtgacactttgtactgtgctcgactccacgcccggtccactggcgggtgttagtagcagcactgttgtttcgtagcggagcatggtggccgtgggaactcctccttggtgacaagggcccacggggccgaaagccacgtccagacggacccaccatgtgtgcaaccccagcacggcaacttttactgcgaacaccaccttaaggtgacactggtactggtactcggtcactggtgacaggctaaggatgcccttcaggtaccccgaggtaacacgggacactcgggatctgagaaggggattgggacttctttaaaagtgcccagtttaaaaagcttctacgcctgaataggcgaccggaggccggcgcctttccattacccactactaaatcc

SEQ ID NO: 2738 - DNA, 679 bp, Chicken picornavirus 5
  isolate 27C, complete genome.1
aaaaggggtccgtgggggttctcccccacggctccttttcccgaccggtctggcgaaccggacggttatcctggttagatgtctgatggttgctggaacgtggtggctatagctgccaccttctggcttcctctattgggcattctagctgggttctttgccaaaattccatcttactctttacccattttctctacccaggcttgcttgtaactggtaagttgacccactggctttagttcatgattattctggtgttggtggacactctttccacaagtaggtagtgtggagttcatgctcgttctgaaccgggaatggcacaacccgtagtaggatcttgcctctgccacacttacttgcgcctgttgcttctagactatgggctgctaaggatgactacggacctctttttgagcaatccgtgtcaagtcaactgtttcatctgatgtacgctggaaatccttgtttctggatgattgtatcctggaggtggtgctgaaatatctcaagccacaggtacgcttctggacttggtgccgctgtcaggtgttacaccccttgtgggcaaatgttgaaccttagtggacgcgtgagatgggaatccatgcctggccatagactggctgataagctcgcggctgatcgagttgcaacagtaatcagttgatttgccact

SEQ ID NO: 2739 - DNA, 682 bp, Foot-and-mouth disease virus
  - type O O/JPN/2010-1/14c (CV_d1)1
gggaggtaaccacaagatttgcgccttcttgtccgaagttagagggctgtaaccgcaaactttgaaccgcctttcccagcgttaacgggatgtaatcacaagatggaccttcatccggaagtaaaacggcaacttacacagttttgcccgttttcatgagaaatgggacgtcagcgcacgaaacgcgcagtcgcttgaggaggacttgtacaaacacgtctcacacaggtacccacaaccgacacaaaacgtgcaacttgaaatcccgcctggtctttccaggtctagaggggtgacactttgtactgtgattgactccacgctcggcccactggcgagtgttagtagtagtactgttgcttcgtagcggagcatggtggccgtgggactccctccttggtaacaaggacccacggggccgaaagccacgtctcaggacccaccatgtgtgcaaccccagcacggcaactttaccacgaaaaccactttaaggtgacactgaaactggtactcaaccactggtgacaggctaaggatgcccttcaggtaccccgaggtaacacgcgacactcaggatctgagaaggggattggggcttctgtaaaagcgcccagtttaaaaagcttctatgcctgaataggcgaccggaggccggcgcctttccttaactattactgcttac

SEQ ID NO: 2740 - DNA, 682 bp, Enterovirus B88
  strain NIV-17-3150-2, complete genome.1
cctgtgggttgttcccacccacagggcccactgggcgctagcacactggtatcacggtacccttgtgcgcctgttttaacccccctcccctcagaagtaacttagaagcataaatcaaacggtcaacaggtggcctagcgcaccagctgggtctagaccaagcacttctgtcaccccggactgagtatcaataggctgcttgcgcggctgaaggagaaaacgttcgttatccgaccagttacttcgggaaacctagtaccaccatggaagttgcgcagcgtttcgctccgcacacccccagtgtagatcaggtcgatgagtcaccgtatcccccacgggcgaccgtgacggtggctgcgttggcggcctgcccatggggtaacccatgggacgcttcaatactgacatggtgtgaagagtctactgagctaattggtagtcctccggcccctgaatgcggctaatcctaactgcggagcagacacccacaagccagtgggcggtctgtcgtaacgggtaactctgcagcggaaccgactactttgggtgtccgtgtttccttttattcttatactggctgcttatggtgacaattgaaaggttgttgccatatagctattggattggccatccggtgactaatagagcgattgtttacttgtttgttggtttcataccaaaa

SEQ ID NO: 2741 - DNA, 683 bp, Chicken megrivirus
  strain Chicken/MG9567/Brazil/2012 polyprotein1
gaaaagaggccgtgggggataacccccacggaccccttttcccgaccggtttggcaaaccggacggttatcctgattagatgtctgatggttgctggaatgtggtggctactgctgccaccttttggcttcctctattgggcatctagttgggtcctttgccattttcccatcttactctttttaacccatcttctaccccaggcatgcttgtaactggtaagttgacccacttggctctgattcatgattctgtttggtgctggtggacactctttccacaagtagattgtgtggagtccatgctcgttctgaaccgggaatggcacaacccgtagtaggatcttgcctctgccacattacatctgcgcctgttgcttctagactatgggctgctaaggatggtttggacccctttttgggtaatccaaatcaagtcaactgtttcatccaatgtacgctggaaatccttgttactgggtgtttacaactggaggtggtgctgaaatattgcaagccacagttgtgcacctagtcctggtgccgctattgggtgttacaccctttgatgggcaaatgttgaaccttagtggacgcgtgagatgggaatccacgcctggccatagactggctgataagctcgcggctgatcgagttgcaacagtaatcagttgatttgccact

SEQ ID NO: 2742 - DNA, 687 bp, Enterovirus A
  strain CHN/BJ/2018-1A, complete genome.1
gggttgttcccacccacagggcccaagcggcgttagtactctggtatcacggtacctttgtatgcctgttttacatcccttcccccgtaacgttagaagaaagcacaaacgacaaatagcaagtccaccaaaccaggtgggtttttgtcaagcacttctgtttccccggacatagtaccaataagctgtacccacggctgaaagggaaaacgttcgttacccggctacttacttcgagaagcctagtaccatcatgaattgtttcaagtgttacgttcagcacaatcccagtgtagttcaggctgatgagtcaccgaattccccacgggcgaccgtgtcggtggctgcgttggcggcctgcctgcgggtattactcgcaggacgcttgattcatgacatggtgcgaagagcctattgagctaggtagtagtcctccggcccctgaatgcggctaatcccaaccacggagccatgcgttgcaatccagcaatgttgtggtcgtaatgagcaattctgtggcggaaccgactactttgggtgtccgtgtttcctgttttatttaccttggctgcttatggtgacaatctagagttgtcatcatatagcgattggattggccatccggatattatctttgtgtgactcattcctagtccataagcattccttgtaatttacacattcatc

SEQ ID NO: 2743 - DNA, 696 bp, Foot-and-mouth disease virus
  - type O,strain O/VIT/8338/20171
acgttaaaggggtgtaaccacaagcttgaaaccgtcttgcccgacgttaatgggttgtaaccacacgcttgtaccacctttcccggcgttatcgggatgcaaccaaaagatgaaccttcacccggaagtaaaacggcaaccacacccagttttgcccgttttcatgagaaatgggacgtcagcgcacgaaacgcgccgtcgcttgaggaagatttgtacaaacacgatttatgcaggcttccacaactgacacgaaccgtgcaatttgaagctccgcctggtctttccaggtctagaggggcaacactttgtactgtgcttgactccacgctcggtccactagcgggtgttagtaacagcactgttgtttcgtagcggagcatgatggccgcgggaactcccccttggtgacaaggacccgcggggccgaaagccacgtcttaacggacccatcatgtgtgcaaccccagcacggcaactttactgtgaaaaccactttaaggtgacactgatactggtactcaaccactggtgacaggctaaggatgcccttcaggtaccccgaggtaacaagtgacactcgagatctgagaaggggacaggggcttctttaaaagcgctctgtttaaaaagcttctatgcctgaataggcgaccggaggccggcgccttttcccactaaaccactactaacttt

SEQ ID NO: 2744 - DNA, 697 bp, Foot-and-mouth disease virus
  - type Asia 1,isolate1
ttcccgacgttaaagggatgtaaccacaagcttaacaccttcgtgtccgaagtcaaaggactgaaaccacatgcttgcaccgccttttccggcgttaatggactgtaaccacaagatggaccttcacccggaagtaaaacggcaacttacacagttttgcccgttttcactagaaacgggacgtctgcgcacgaaacgcgccgccgcttgaggaggacttgtacaaacacgatctacgcaggttcccacaactggcttaaaacgtgcaatttgaaaccccgcctggtctttccaggtctagaggggtgacaccttgtactgtgcttgactccacgctcggtccactggcgagtgttagtagtagcactgttgcttcgtagcggagcatgatggccgcgggagtccctccttggtgacaaggacccgcggggccgaaagccacgtcctacggacccatcatgtgtgcaaccccagcacggcaactttgacacgaaaaccactttaaggtgacactgatactggtactcaaacactggtgacaggctaaggatgcccttcaggtaccccgaggtaacacgcggcactcgggatctgagaaggggactggggcttctgtaaaagcgcccagtttaaaaagcttctatgcctgaataggcgaccggaggccggcgcctttcctttaattgccactaactac

SEQ ID NO: 2745 - DNA, 701 bp, Foot-and-mouth disease virus
  partial polyprotein, P1 region,strain1
ttcccgacgttaatggggaaacaaccacaagcttaacaccgtcttgcccgacgtaaaagggctgcaaccaaaaagcttgtgccgcctttcccggcgttaatgggaggtaaccacaagacaaaccttcacccggaagtaaaacggcaacttcacacagttttgcccgttttcgtgagaaatgggccgtcaacgcacgaaacgcgccgtcgcttgaggaggacttgtacaaacacgatctatgcaggtttccacaactgacacaaaccgtgcaacttgaaaccccgcctggtctttccaggtctagaggggcgacattttgtactgtgcttgactccacgctcggtccactagcgagtgttagtagtagcactgttgcttcgtagcggagcatgatggccgtgggagctcccccttggtgacaaggacccacggggccaaaagccacgtcctaccggacccatcatgtgtgcaaacccagcacggcaactttactgcgaaaaccactttaaggtgacactgatactggtactcaatcactggtgacaggctaaggatgcccttcaggtaccccgaggtaacacgcgacactcgggatctgagaaggggactggggcttctttaaaagtgcccagtttaaaaagcttctatgcctgaataggcgaccggaggccggcgccttttcactgttttactactgtttc

SEQ ID NO: 2746 - DNA, 702 bp, Human enterovirus 92
  strain RJG7, complete genome.1
tttaaaacagcctgtgggttgtacccacccacagggcccacgcggcgttagtactctggtatcacggtacctttgtatgcctgttttatctcccttcccccgtaacgttagaagaatgaacaaaagacaattagcaaatccaccaacccaggtgggttttcgtcaagcacttctgtttccccggacctagtaccaataagctgtgcccacggctgaaggggaaaacgttcgttatccggctacctacttcgagaagcctagtaccaccaatgattgtctcaagtgttacgctcagcacaaccccagtgtagttcaggtcgatgagtcaccgaattccccacgggcgaccgtgtcggtggctgcgttggcggcctgcctgcgagtttcactcgcaggacgcttgattcatgacatggtgcgaagagcctattgagctaggcagtagtcctccggcccctgaatgcggctaatcctaaccacggagccatgcgtcacaaaccagtggcgtcatggtcgtaacgagcaattctgtggcggaaccgactactttgggtgtccgtgtttcctgttttatttaccttggctgcttatggtgacaatctagagttgtcatcatatagcgattggattggccatccggatattactttgtgtgatttatctcttgctcgtaagcaattttaaatagtttatagcatcatt

SEQ ID NO: 2747 - DNA, 708 bp, Coxsackievirus A14
  isolate SEN-14-254, complete genome.1
ggggccggagctctggtgatacgttacctttgtgcgcctgttttatttccctaccccggaacaatctagaagcaacgcgctactggccaatagaaagtgtagcaaaccagctacatcccggtcaagcacttctgtctccccggaccgagtatcaataaactgctaacgcggttgaaggagaaaaggttcgttacccggccaactacttcgaaaagcccagtaacaccatgaaagttgcagagtgtttcgctcagcacttcccccgtgtagatcaggtcgatgagtcaccgcgatccccacgggcgaccgtggcggtggctgcgttggcggcctgcctatggggcaacccataggacgctctaatacagacatggtgcgaagagcctattgagctagttggtagtcctccggcccctgaatgcggctaatcctaactgcggagcttatgctcgcgaaccagcgagtagtgagtcgtaacgggtaactctgcagcggaaccgactactttgggtgtccgtgtttccttttattctcatattggctgcttatggtgacaatcaaagaattgttaccatatagctattggattggccatccggtgtgcaacagagctattgtctactcttttgttggatttgttccattgtcctctttcaccacactaaatactctacagtatatactttcccttaattcaaggaaacgatc

SEQ ID NO: 2748 - DNA, 709 bp, Foot-and-mouth disease virus
  - type O,isolate O/VN/SL21/20061
aagttttgccgtcgttcccgacgttaaagggagataaccacaagctttgcaccttcttgcccgaagtaaaagggctgcaaccgcaagctttaaaccgcctttcccggcgttaacgggatgcaaccataagatggaccttcgcccggaagtaaaacggcaactcacacagttttgcccgttttcacgagaaatgggacgtcagcgcacgaaacgcgccgtcgcttgaggaggacttgtacaaacacgatctacgcaggttcccacaaccgacacaaaccgtgcaatttgaaatcccgcctggtctttccaggtctagaggggtaacactttgtactgtgattgactccacgctcggtccactggcgagtgtaagtagtagtactgttgcttcgtagcggaacatggtggccgtgggactccctccttggtaacaaggacccacggggccgaaagccacgtcttggacccaccatgtgtgcaaccccagcacggcaaccatactacgaaaaccactttaaactggcactgatactggtactcaaccactggtgacaggctaaggatgcccttcaggtaccccgaggtaacacgcgacactcgggatctgagaagggggctggggcttctataaaagcgcccagtttaaaaagcttctatgcctgaataggcgaccggaggccggcgcctttctctacttactactgtttac

SEQ ID NO: 2749 - DNA, 712 bp, Foot and Mouth Disease Virus
  A L-fragment of RNA genome.1
taagtgttaccgtcgtgcccgacgttaaagggaagtaaccacaagcttgacaccgtcttgtccgacgttaaagggctgtagccacaagcttgcaccgcctttcccggcgtaaatgggatgtaaccacaagacacaccttcagccggaagtaaacggcaacaccacacagttttgcccgttttcatgagaaatgggacgtctgcgcacgaaacgcgccgtcgcttgaggagaacttgtacaaacacgatctacgcaggtttccacaactgacacgaaccgtgcaacttgaaactccgcctggtctttccaggtctagaggggtaacactttgtactgtgtttgactccacgcttggtccactagcgagtgttagtagcagcactgttgcttcgtcgcggagcatgatggctgtgggaactcccccttggtaacaaggacccacggggccaaaagccacgtcctcacggacccatcatgcgtgcaaccccagcacagcaactttactgcgaaagccactttaaggtgacactgatactggtactcaaccactggtgacaggctaaggatgcccttcaggtaccccgaggtaacatgcgacactcgggatctgagaagggggctgaggcttctttaaaagcgctcagcttaaaaagcttctatgcctgaataggcgaccggaggccggcgcctttccacttaccaatactgtttt

SEQ ID NO: 2750 - DNA, 713 bp, Coxsackievirus
  A2,strain USA/2014-19510, complete genome.1
ccacagggcccacggggcgctagcacactggtgttacggcacctttgtgcgcctgttttactcccctttcccctgtaatttagaagtatcgcaccacggatcaatagcaggtgtgtcgcaccaggcacatctagatcaggcacttctgtctccccggaccgagtatcaataggctgctagcgcggctgaaggagaaaacgttcgttacccggccaactacttcgagaagcttagtaccaccatgaacgttgcagagtgtttcactcagcacaaccccagtgtagatcaggtcgatgagtcaccgcattccccacgggcgaccgtggcggtggctgcgttggcggcctgcctatggggcaacccatgggacgctctaatactgacatggtgcgaagagcctattgagctagttggtagtcctccggcccctgaatgcggctaatcctaaccgcggagcatgtactcacaacccagtgggcagcatgtcgtaacgggtaactctgcggcggaaccgactactttgggtgtccgtgtttccttttattcttacattggctgcttatggtgacaactgaaggattgttaccatatagctattggattggccatccggtgtccaacagagctctgatttatcagtttgttggctttgtgcctttatcacctacagcctactcaaccttagtgtttttgatacaccttaacaataggaa

SEQ ID NO: 2751 - DNA, 715 bp, Ljungan virus
  strain 340 polyprotein gene, complete cds.1
ggtggggtgggtacgtttctcgctcattgagtgggggcgtggctcaccaaccacacctggttggttcccaggttcatacaataaccacctctttgtaacaactacacctaagcttaatttgcccgcttgaactggacgaaaccgcttggaataagtttggttctcttttgagtgtgttttgtgttagcataatttctgtctctagagtgctttacgctctagtaggggctgtacccgggcggtcccactcttcacaggaatctgcacaggtggctttcacctctggacagtgcattccacacccgctccacaatagaagataatgtatgtctttgtttgtgaaatgcttatgaaacgagtgtgtaggcgtagcggctacttggatgccagcggaactcccctagtggtaacactagcctctgggcccaaaaggcatgtctttgaccattcaagtacacaaccccagtgatgcacacacctagtaatggcttagtaatggacattgattgattatcagacaattgctaggaggcttaggtatgacgggctgaaggatgccctggaggtacccgcaggcaaccttaggagactgtggatctgaccaggggcccaccatggaagcatgggtagaagtcttcggaccttgggttaaaaaacgtctaggcccgccccccacagggatgtggggtttcccttataaccccaatactacact

SEQ ID NO: 2752 - DNA, 717 bp, Echovirus E6
  strain GHA:CEN:ASE/2017 polyprotein gene, complete1
acccacagggcccactgggcgctagcacactggtatcacggtacctttgtgcgcctgttttatccaccttaccccactgtaacttagaagttaaccaaacacggtcactaggtggctcagtataccaactgagtctagaccaagcacttctgttaccccggactgagtatcaataggctgctcgcgcggctgaaggagaaaacgttcgttacccggccaattacttcgagaaacctagtaccaccatgaaggttgcgcagcgtttcgctccgcacttccccagtgtagatcaggccgatgagtcaccgcgtacctcacgggcgaccgtggcggtggctgcgctggcggcctgcccatggggcaacccatgggacgcttcaaaactgacatggtgcgaagagtctattgagctaattggtagtcctccggcccctgaatgcggctaatcccaactgcggagcagatacccacactccagtgggcagtctgtcgtaatgggcaactctgcagcggaaccgactactttgggtgtccgtgtttccttttattcttatactggctgcttatggtgacaattgagagattgttaccatattgctattggattggccatccggtgacaaacagagcaataatctacttatttgttggtttcgtaccattgaactttagagtactgaagacccttaactttatactaattctcaacacagcaaa

SEQ ID NO: 2753 - DNA, 719 bp, Foot-and-mouth disease virus
  - type Asia 1,isolate1
cccataaaggttttaccgtcattcccgacgttaaagggaggtaaccacacgcttgagaccgtcttgtccgacgttaacggactggaaccacaagcttataccgcctttcccggcgttaacggaatgtaaccacaagatggaccttcacccggaagtaaaacggcacacacacacaattttgcccgttttcacgagaaacgggacgtctgcgcacgaaacgcgccatcgcttgaggaggacttgtacaaacacgatctacgcaggtttcccaaccgacacaacccgtgcaacttgaaactccgcctggtctttccaggtctagaggggtgacattttgtactgtaattgactccacgctcggtccactagcgggtgtttagtagctgtattgttgcttcgtagcggagcataatggccgcgggagctcccccttggtaacaaggacccacggggccgaaagccacgtcctaacggacccattatgtgtgcaaccccagcacggcaacttactgtgaaaaccactttaaggtgacactgatactggtactcaactactggtggcaggctaaggatgcccttcaggtaccccgaggtaacatgcgacactcgggatctgagaaggggaccgggacttctttaaaagtgcccggtttaaaaagcttctatgcctgaataggcgaccggaggccggcgcctttcttttgattactactgctttt

SEQ ID NO: 2754 - DNA, 719 bp, Coxsackievirus
  A16,isolate C138/CHW/AUS/2016 polyprotein gene,1
ccacccacagggcccacggggcgctagcacactggtgtcacggcacctttgtgcgcctgttttatttcccctcccccccgcaatttagaagttttgcactacagatcaatagcaggtgtgtcgcaccaggcacatctagatcaagcacttctgtttccccggactgagtatcaataggctgctcacgcggctgaaagagaaagcgttcgttatccggccaactacttcgagaagcttagtaccaccatgaacgttgcagagtgtttcgctcagcacatccccagtgtagatcaggtcgatgagtcaccgcactccccacgggcgaccgtggcggtggctgcgttggcggcctgcctatggggcaacccataggacgctctaataccgacatggtgcgaagagcctattgagctagttggtagtcctccggcccctgaatgcggctaatcctaactgcggagcatgtactcacaatccagtgggcagcatgtcgtaacgggcaactctgcagcggaaccgactactttgggtgtccgtgtttcctttttattcttatattggctgcttatggtgacaattgaagaattgttaccatatagctattggattggccatccggtgtctaacagagctattgtttacctgtttgttggatacgtccctctcaatttcaaggtcattaaaactcttaattatatactacttctcaactgtgagaa

SEQ ID NO: 2755 - DNA, 719 bp, Swine vesicular disease virus
  strain SVDV Itl. 1-92 polyprotein1
cacccacagggcccactgggcgctagtacactggtatcacggtacctttgtgcgcctgtttgaccgacccaccccgaatgcaacttagaagcacaacttggatggtcaataggcggctcggtatgccaactgagtctagaccaagcacttctgttaccccggactgagtaccaataggctgctcgcgcggctgaaggggaaaccgttcgttacccgactaactacttcgagaaacctagtaccaccatgaaagttgcgcagcgtttcgttccacacaaccccagtgttgatcaggtcgatgagtcaccgcaaaccccacgggcgaccgtggcggtggctgcgctggcggcctgcccatgaggcaactcatgggacgcttcaatactgacatggtgcgaagagtctattgagctagttggtagtcctccggcccctgaatgcggctaatcctaactgcggagcagatacccacacaccagtgggcagtctgtcgtaatgggcaactctgcagcggaaccgactactttgggtgtccgtgtttccttttgttcttattctaaccacttatggtgacaattgagaggctgtgaccatattgccactgagttgaccacccggtgacgagcagaacagttgcttacctgtctgttggtcacgtatcattaaaccacaaatccttgaacgctctcctattttgtcataacgcccaacacgtcaaa

SEQ ID NO: 2756 - DNA, 720 bp, Foot-and-mouth disease virus
  - type A,isolate TUR_004/20031
ccccccctaagttttaccgtcgttcccgacgttaaagggatgtaaccacaagctagaaaccgtcttgcccggcgttatagggctgtaaccacatgcttgtaccgcctttcccggcgacaacgggatgtaaccacacgattgaccttcacccggaagtaaaacggcaacttcacacatttttgcccgttttcacgagaaacgggacgtctgcgcacgaaacgcgccgccgcttgaggaagacttgtacaaacacgatctaagcaggtctccacaactgacacaaaccgtgcaacttgaaactccgcctggtctttccaggtctagaggggtgacactttgtactgtgcttgacaccacgctcggtccactagcgggtatgagtagcagaactgttgcttcgtagcggagcatggtggccgtgggaactcctccttggtaacaaggacccacggggccaaaagccacgtcctgtggacccaccatgtgtgcaaccccagcacggcaatttttctgtgaaaactaccttaaggtgacactgatactggtactcaaccactggtgacaggctaaggatgcccttcaggtaccccgaggtaacacgcgacactcgggatctgagaaggggactgggacttctttaaaagtgcccagtttaaaaagcttctatgcctgaataggcgaccggaggccggcgcctttcttttaaacactactagacta

SEQ ID NO: 2757 - DNA, 726 bp, Enterovirus B84
  strain GHA:BAR:TES/2017 polyprotein gene, complete1
ggttgttcccacccacagggcccattgggcgctagcacactggtatcacggtacccttgtgcgcctgttttatacacccttccccaacgaaacttagaagtaaagcaacaaggtcaataggtagctcagtgagccaactgagttatgaccaagcacttctgtcaccccggactgagtatcaataggctgctcacgcggctgaaggagaaagcgttcgttatccggctaactacttcgagaaacctagtaccaccatgaaggttgcgtagcgtttcgatcagcacaaccccggtgtagatcaggccgatgagtctccgcattcctcacgggcgaccgtggcggtggctgcgctggcggcctgcccatggggcaacccatgggacgcttcaatactgacatggtgcgaagagtctattgagctagttagtagtcctccggcccctgaatgcggctaatcctaactgcggagcacacacccccaacccaggaggcagtgtgtcgtaacgggtaactctgcagcggaaccgactactttgggtgtccgtgtttccttttattcttatactggctgcttatggtgacaattgagagattgttaccatatagctattggattggccatccggtgactaacagagctattgtatacctgtttgttggttttataccattaaattgcaaagttctagagaccctcaattttatcctattactaaacgcagcaaa

SEQ ID NO: 2758 - DNA, 726 bp, Enterovirus J
  strain CHN/BJ/2018-8J, complete genome.1
acatgggcacccagagggcccacgtggcgtagaactcacgtggcgtagaactccggtattacggtacccttgttcgcctattttaccaccccttccccagaaacttagaagtcatgatcacaaggctcaatagatacttgggcaaaccagcccaaggacgagcaagcacttctgtctccccgggaggcaacgctgttaggctgtccccacggccgaaggcaacgctaccgttaaccggcgtggtactgcgggaagtctagtaacatcattgaatttctttgacgttacgttcagcacacaaacccagtgtgtagttttggctgatgagtgcctgcattccccactggcgacagtggcaggcgctgcgttggcggccaactctcagggcaacctgagagacgtcaaattaaggacatggtgtgaagaacctactgcgctactgcgtagtcctccggcccctgaatgcggctaatcctaactcgggagcatctgcacacaatccagtgtgaagggtgtcgtaacgggcaactcctgagcggaaccgactactttgggtgtccgtgtttcctgttttatttaccttggctgcttatggtgacaatctagattgttaccatatagcaattgggttggccacctggttttgtaagcttgtgacttttagtacgctaaaacacttactataatacaacacagacattactataaaaccacttgaaagagagg

SEQ ID NO: 2759 - DNA, 727 bp, Hepatovirus A
  isolate KSA215 polyprotein gene, complete cds.1
tcccctctttgggctactctggctgggggtagtaaaatacccagccctcgtttgcctagagtttaggctaaaacccctttccctttgtaaatacgttcatttgtaaatattgattcctgcaggttcaggctttcttgaatcatgttgtgctttaacacacacttactattttgccataagtgcgatggatggaaacttccatcaaaccttttaacacaggatgttattagggcagtttctcttaatatatctctgggacattcttcggtcccattgtttctcctttctatcttcttgttttccgggttctcaggataccaatggagcgaccactgcgcccggtggggttaaccagaagattagcttctggctgtagctgctaaaagtcctgacgttatagagcgccgtcacggagttagtgattaaactcaggtgtttggaaattcattgatcttctagaaagggtaggctacgggtgaaaccctttacactaatacctatattaggagatgtgttgcataggtgaagggtactggtaaaggggattttcacgatgaacctttcaacagttgtggacccacctcatgcactagatgctttgatttgaagaacacttggggtcacttcccgagtgatcgcgccactaggcgccctcctctatgagttgtaggggtaatcaggggcatttaggtttccacatttaaaagatttatatgattgattcaaa

SEQ ID NO: 2760 - DNA, 729 bp, Echovirus E9
  strain 11-2042-1, complete genome.1
gggttgttcccacccacagggcccacggggcgctagcactctggtatcacggtacctttgtgcgcctgttttatccaccctcccccaaatgtaacctagaagtacaatactaacggtcaataggcggcacagcacaccagctgggtctagaccaagcactcctgttgccccggactgagtatcaataggctgcctccgcggctgaaggagaaaacgttcgttatccggccaattacttcgagaaacccagtaccaccatggaagttgcgcagcgtttcgttccgcacaaccccagtgtagatcaggtcgatgagtcaccgcattccccacgggcgaccgtggcggtggctgcgttggcggcctgcccatggggtgacccatgggacgcttcaatactgacatggtgtgaagagtctattgagctaattggtagtcctccggcccctgaatgcggctaatcctaactgcggagcagacactcacaagccagtgagcagtctgtcgtaacgggtaactctgcagcggaaccgactactttgggtgtccgtgtttccttttattcttacattggctgcttatggtgacaattgagaaattgttaccatatagctattggattggccatccggtgactaacagagcaattgtctatctgtttgttggatttgtaccactgaactataaggtattgaacacacttaactttatcatatcactaaactcagcaaa

SEQ ID NO: 2761 - DNA, 730 bp, Echovirus E11
  strain HAI/2016-23057 polyprotein gene, complete cds.1
gttgttcccacccacagggcccactgggcgctagcacactggtatcacggtacctttgtgcgcctgttttatgcttcctcccccactatagtaatctagaagcttgaactacatggccaacagacaacccggtacaccaaccgggccccggccaagcacttctgtatccccggactgagtatcagtaagctgctcgcgcggctgaaggagaaaacgttcgttacccggccacttacttcgagaaacctagtaacgccatgaaagttgcgcagcgtttcgctccgcacaaacccagtgtagatcaggtcgatgagtcaccgcatcccccacgggcgaccgtggcggtggctgcgttggcggcctgcccatggggtaacccatgggacgcttcaatactgacatggtgcgaagagtctattgagctaagtggtagtcctccggcccctgaatgcggctaatcctaactgcggagcagatacccacactccagtgggcagtctgtcgtaacgggcaactctgcagcggaaccgactactttgggtgtccgtgtttccttttgtcttttacactggctgcttatggtgacaattgaaagattgttaccatatagctattggattggccatccggtatcaaacagagcaattatttacttgtttgttggttatatacctctcgataccaaggttctaaaaacactcaactacatcttgttattgaatacgttgaa

SEQ ID NO: 2762 - DNA, 740 bp, Rattus tanezumi parechovirus
  strain Wencheng-Rt386-3 polyprotein1
cccgtggcttatgccacgggacccgtgcccccgtccagggggttttacttatgctcaggcgtttgcattatcgcctggatctggctctgggcaccctttcagcccctgggcatgggtttaaactgcctacctgtaacacttaacatctaagaaactgatttgtaaccaaccctggccagatgttgccagcccaagccacttggaataaggtgggcaatgtcacattggtgcttaaaggttgcgtccaaatttttcttttccaaccactcatgtggacggtgtgcaaactccaccgtaacacttctaggtgacttccacacttgtggggctaaagcaccagagtctttgcttcaaccatattgtggtgacagcaaagcatcctgaaattagttagtaatgattctagatccacttctgtggtgctgcatgcctgcggagcaatggggggtgaccctcacctcaggggccgaaagccacggtgtttaaagcacccatgcagtatgcttgtctgtttaggattgtgaacactgaaagtaaggatgatgagtggtcactgtggtcactggttgtcgtacgggggctgaaggatgcccagaaggtacccgtaggtaaccttaagagactatggatctgatctggggccagggagtgatgtactctatacacctgccttggttaaaaaacgtctaggcccccccaacctgggggaccaggttttcctggtcattttgcaaaggaat

SEQ ID NO: 2763 - DNA, 741 bp, WUHARV Sapelovirus 2
  polyprotein gene, complete cds.1
tcacactcatttcgccccctcaccctactcaggcaacccccaccccttctcttacgggagttagggccaaggatctagtgtagtggtgttgtatccccttaccttaaacccatcccatccaagcggactggtattatggctttagattgaataatggttgatgaatccaaacctgttactcattcaggggaaaaatgaagacattctctatggatttgacttgttacgaccaagagttagcgcttcgcgcgctggccgtatggactgtttaatggttactctatggattatgatttcagggttggccgcccaggataaaaggcaattgtggtaagtgatgttagtcattggcagttgaaacctgcctagaacatctaaggtctacgctgtgcgggccgaagtaagtctaggaacaacagggagtatgctgttttttgctttcacccaacacgaccgtacacgaaagagctagaggcatctggaggcaaagggaaaagaatttcttagcccgaatgttcattagagtccttgacgaatgcgtcccctctgtcccgagggtgaggcgtatggcgcatgctcatggcattactccaaggtgtatctagaggggggggccccctctacttagtctagtgctacctgacagggccgcggctggtcgtttgtgtatggtataaccagtagtaatcccccatggattgctttaactccccctcctcccttcacaagacattctctaag

SEQ ID NO: 2764 - DNA, 741 bp, Human echovirus 2
  strain Cornelis, complete genome.1
ttaaaacagcctgtgggttgatcccacccacagggcccattgggcgctagcactctggtattacggtacccttgtgcgcctgttttacacgcccctccccaagcaacttagaagtctgtcacaaatggtcaatagacagctcaacacgccagttgagtctagaccaagcacttctgtcgccccggaccgagtatcaatagactgctagcgcggttgaaagagaaaacgttcgttacccggccaactacttcgggaaacctagtaccaccatgaaagttgcgcagtgtttcgctccgcacaaccccagtgtagatcaggtcgatgagccaccgcattccccacaggcgactgtggcggtggctgcgttggcggcctgcccatggtacaacccatgggacgcttcaatactgacatggtgcgaagagtctactgagctagttggtagtcctccggcccctgaatgcggctaatcctaactgcggagcaggtacccacgagccagtgggcagcctgtcgtaatgggcaactctgcagcggaaccgactactttgggtgtccgtgtttccatttactcttatactggctgcttatggtgacaatcacggaattgttaccatatagctattggattggccatccagtgactaacagagcgattatattcctttgtgttggttttgtaccactcaccgtcacgagctttacaacgctaaactacattttgtcattgaacacggcaag

SEQ ID NO: 2765 - DNA, 741 bp, Human echovirus 25
  strain JV-4 complete genome.1
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacttagtctgaaagttttgagaacactcaactacgttttattgctgaatagtgcaag

SEQ ID NO: 2766 - DNA, 745 bp, Unknown
  Description of Unknown: Human coxsackievirus A6 strain Gdula, complete genome.1 sequence
ttaaaacagcctgtgggttgcacccactcacagggcccactgggcgctagcacactgatttcccggaatccttgtgcgcctgttttatatcccctcccccatgcgcaacttagaagcaatctacaccttcgatcaatagcaggcgtggcgcgccagccatgtctagatcaagcacttctgtttccccggactgagtatcaataaactgctcacgcggttgaaggagaaaatgttcgttacccggctaactacttcgagaaacctagtagcaccatgaaaattgcagagcgtttcgctcagcgcttcccccgcgtagatcaggctgatgagtcactgcattcctcacgggcgaccgtggcagtggctgcgttggcggcctgcccatggggtaacccatgggacgctctaatatggacatggtgtgaagagtctattgagctagttagtagtcctccggcccctgaatgcggctaatcctaactgcggagcacatacccccaaaccagggggcggtgtgtcgtaacgggcaactctgcagcggaaccgactactttgggtgtccgtgtttccttttattcttatattggctgcttatggtgacaattgaaagattgttaccatatagctattggattggccatccggtgaataacagagccttgatatacctttttgtagggtttataccacttactcttcgcgttgttgagactctaaagtacattctaatcttgaacactagaaa

SEQ ID NO: 2767 - DNA, 746 bp, Coxsackievirus
  A6,strain CVA6 -310167012-FRA-2010, complete genome.1
ttaaaacagcctgtgggttgcacccacccacagggcccactgggcgttagcacactgattccacggaatccttgtgcgcctgttttacaaccccttcccaaactcgtaacttagaagaatagcacgctaccgatcaatagcaggcatggcgcaccagccatgtctagatcaagcactcctgtctccccggaccgagtatcaatagactgctaacgcggttgaaggagaaaacgttcgtcacccggctaactacttcgagaaacctagtaacaccattgaagctgcggagcgtttcgctcagcactacccccgtgtagatcaggtcgatgagtcactgcaacccccacgggcgaccgtggcagtggctgcgttggcggcctgcctatggggtaacccataggacgctctaaagtggacatggtgcgaagagtctattgagctagttagtagtcctccggcccctgaatgcggctaatcctaactgcggagcgcataccctcaacccagggggtggtgcgtcgtaacgggcaactctgcagcggaaccgactactttgggtgtccgtgtttccttttattcttatactggctgcttatggtgacaattgaaagattgttaccatatagctattggattggccatccagtgactaatagagctttgatatacctgtttgtgggttttgttccactcaccaatcgtgcagtttacactctgaagtacattttaatcttgaataatagaaa

SEQ ID NO: 2768 - DNA, 746 bp, Coxsackievirus
  A7 gene for polyprotein, polyprotein region,strain1
tttaaaacagcctgtgggttgcacccacccgcagggcccactgggcgccagcactctggtttcgtggaacctttgtgcgcctgttttatcaccctcttcccaaactcgcaacttagaagtaacactttactgatcaatagcaggcgtggcgcaccagccatgtctagatcaagcacttctgtctccccggaccgagtatcaataggctgctcacgcggctgaaagagaaaacgttcgttatccggctaactacttcgagaaacttagtagcaccgttgaaactgcagggtgtttcgctcagcacttcccccgtgtagatcaggtcgatgagtcactgcaatccccacgggcgaccgtggcagtggctgcgttggcggcctgcctatggggtaacccataggacgctctaatgtggacacggtgcgaagagtctattgagctagttagtagtcctccggcccctgaatgcggctaatcctaactgcggagcgcatgcccccgaaccaggaggtggtgcgtcgtaatgggtaactctgcagcggaaccgactactttgggtgaccgtgtttctttttattcctattatggctgcttatggtgacaattaaagaattgttaccatatagctattggattggccatccggtgtctaacagagctattatatatctgtttgttgggtttgttccattatcacacacatcactcaatacattgtatttcattgtgggattgaacacaagaaa

SEQ ID NO: 2769 - DNA, 746 bp, Coxsackievirus
  A8,isolate 18-38/TJ/CHN/2018 polyprotein gene,1
ttaaaacagcctgtgggttgtacccactcacagggcccactgggcgttagcactctgattccgcggaatccttgtgcgcctgttttaaaacccctccccacacttgtaatctagaagtaatgcactcttatgatcaatagcaggcgtggcgcaccagccatgtcttgatcaagcacttctgtctccccgggctgagtatcaatagactgctcacgcggttgaaggagaaaatgctcgttatccggctaactacttcgagaaacctagtagcaccagtgaagctgcggggcgtttcgttcagcacttcccccgtgtagatcaggtcgatgagtcactgcgttccccacgggcgaccgtggcagtggctgcgttggcggcctgcctatggggcaacccataggacgctctaatgtggacatggtgcgaagagtctattgagctagttagtagtcctccggcccctgaatgcggctaatcctaactgcggagcacatgccctcaagccagagggtggtgtgtcgtaatgggcaactctgcagcggaaccgactactttgggtgtccgtgtttccttttattcttatactggctgcttatggtgacaatcacagaattgttgccatatagctattggattggccatccggtgcacaacagagcaattatctatttatttgttggatttacccctttgacacttacatctcttaacacattgcactacatcctatttttgaatacgaggaa

SEQ ID NO: 2770 - DNA, 747 bp, Coxsackievirus
  A6,strain CVA6 -3141760671-FRA-2014, complete1
ttaaaacagcctgtgggttgtacccacccacagggcccactgggcgctagcacactgattctatggaatctttgtgcgcctgttttataatccctttcccaaaattgcaacttagaagaacagtactttatcgatcaatagcaggcatgacgcaccagttatgtctagatcaagcactcctgtttccccggaccgagtatcaatagactgctaacgcggttgaaggagaaaacgtccgttacccggctaactacttcgagaaacctagtagcaccattgaagctgcagagcgtttcgctcagcacttccccagtgtagatcaggttgatgagccactgcactccccacgggcgaccgtggcagtggctgcgttggcggcctgcctatgggacaacccataggacgctctaaagtggacatggtgcgaagagtctattgagctagttagtagtcctccggcccctgaatgcggctaatcctaactgcagagcacatgccctcaacccagggggtggtgtgtcgtaacgggcaactctgcagcggaaccgactactttgggtgtccgtgtttccttttattcttatattggctgcttatggtgacaattgagagattgttaccatatagctattggattggccatccggtgaccaacagagctttgatatacctgtttgcgggttttattccactctccagtcgttcagtccatactataaagtgcattttgattctgaacaatagaaa

SEQ ID NO: 2771 - DNA, 747 bp, Human enterovirus sp.
  89 polyprotein gene, complete cds.1
ttaaaacagcctctgggttgcacccacccacagggcccactgggcgctagcacactggtatcacggtacctttgtgcgcctgttttatacaccctccccccttgtaacttagaagaaacaaacaaacgatcaatagtaggcttagcactccagctaagtctcgatcaagcacttctgttaccccggaccgagtatcaataggctgtacccacggctgaaagagaaaacgttcgttacccggctatctacttcgggaaacccagtaccatcatgaagattgcaaagcgtttcgctcagcacaaccccagtgtagatcaggtcgatgagtcactgcattccccacaggcgactgtggcagtggctgcgttggcggcctgcctatggggaaacccataggacgctttaatattgacatggtgcgaagagtctactgagctaggtagtagtcctccggcccctgaatgcggctaatcccaaccacggagcaggcgctcacactccagtgagtagcttgtcgtaatgcgaaagtctgtggcggaaccgactactttgggtgtccgtgtttccttttatttttatcatggctgcttatggtgacaatctaagattgttatcatatagctattggattggccatccggtgaattctagagatattatttacttgtttgttggttttaccacattaaacattaccaattacagaactctcctctacatcctgttattgaataatagaaagagaaa

SEQ ID NO: 2772 - DNA, 748 bp, Unknown
  Description of Unknown: Human coxsackievirus A6isolate TW/273/09, complete genome.1 sequence
ttaaaacagcctgtgggttgcacccacccacagggcccactgggcgccagcacactgattctacggaacctttgtgcgcctgttttacaaccccttccccgaaactcgcaacttagaagaacagcacgctatcgatcaatagcaggcatggcgcgccagtcatgtctagatcaagcacttctgtctccccggactgagtatcgatagactgctaacgcggttgaaggagaaaacgtccgttacccggctaactacttcgagaagcctagtaacaccattgaaactgcagagtgtttcgctcagcactaccccagtgtagatcaggtcgatgagtcactgcactccccacgggtgaccgtggcagtggctgcgttggcggcctgcctatggggtaacccataggacgctctaaagtggacatggtgcgaagagcctattgagctagttagtagtcctccggcccctgaatgcggctaatcctaactgcggagcgcatgccctcaatccagggggtggtgcgtcgtaatgggcaactctgcagcggaaccgactactttgggtgtccgtgtttccttttattcttatgttggctgcttatggtgacaattgagagattgttgccatatagctattggattggccatccagtgactaacagagctttgatatacctgtttgtgggttttgttccactcaccaattgtacagttcaaactttgaagtacattttaattctgaataatagaaa

SEQ ID NO: 2773 - DNA, 749 bp, Coxsackievirus
  A6,strain FH233/SX/CHN/2013, complete genome.1
ttaaaacagcctgtgggttgcacccacccacagggcccattgggcgctagcacactgattctatggaatctttgtgcgcctgttttagtatccctccccctcaaacacgtaacttagaagaatagcacgctatcgatcaatagcaggcgtggcgcaccagccatgtctagatcaagcacttctgtctccccggattgagtatcaatagactgctaacgtggttgaaggagaaaacgtccgttacccggctaactacttcgagaaacctagtaacaccattgaaactgcagagcgtttcactcagcactaccccagtgtagatcaggtcgatgagtcactgcattccccacgggcgaccgtggcagtggctgcgttggcggcctgcctatggggtgacccataggacgctctaaagtggacatggtgtgaagagtctattgagctagttagtagtcctccggcccctgaatgcggataatcctaactgcggagcgcatgccctcaatccagggggtggtgcgtcgtaacgggcaactctgcagcggaaccgactactttgggtgtccgtgtttccttttatctttatactggctgcttatggtgacaattgagagattgttaccatatagctattggattggccatccagtgaccaacagagctttgatttacctgtttgtgggttttgttccactcaccagttgtacagttcatactttgaagtatattttaatcctgaataatagaaa

SEQ ID NO: 2774 - DNA, 750 bp, Coxsackievirus
  A6,isolate HK418670/2012, complete genome.1
acttaaaacaaacctgtgggttgcacccacccacagggcccactgggcgctagcacactgattctatggaatctttgtgcgcctgttttataaccccttccccaaaactgtaacttagaagaatagcactctatcgatcaatagcaggcatggtgcgccaatcatgtctagatcaagcacttctgtctccccggatcgagtatcaatagactgctagcgcggttgaaggagaaaacgtccgttacccggctaactacttcgagaaacttagtagcaccattgaagccgcagagtgtttcgctcagcactcccccagtgtagatcaggtcgatgagtcactgcactccccacgggcgaccgtggcagtgactgcgttggcggcctgcctatggggcaacccataggacgctctaaagtggacatggtgcgaagagtctattgagctagttagtagtcctccggcccctgaatgcggctaatcctaactgcggagcgcatgccctcaatccagggggtggtgtgtcgtaacgggcaactctgcagcggaaccgactactttgggtgaccgtgtttccttttattcttatactggctgcttatggtgacaattgagagattgttaccatatagctattggattggccatccagtaaccaacagagctttgatatacttgtttgtgggtttcgttccactcaccaatcgtacaatccatactctaaagcacattttgattctgaacaatagaaa

SEQ ID NO: 2775 - DNA, 750 bp, Coxsackievirus
  A6,isolate 12/GD/CHN/2018, complete genome.1
ttaaaacagcctgtgggttgcacccacccacagggcccactgggcgctagcacactgattctacggaatctttgtgcgcctgttttataacccccttccccccaaaactgtaacttagaagaatattacactactgatcaatagcaggcatggcgcgccagtcatgtctagatcaagcacctctgtctccccggactgagtatcaatagactgctagcgcggttgaaggagaaaacgtccgttacccggctaactacttcgagaaacctagtagcaccattgaagctgcggagtgtttcgctcagcactcccccagtgtagatcaggtcgatgagtcactgcactccccacgggcgaccgtggcagtggctgcgttggcggcctgcctatggggcaacccataggacgctctaaagtggacatggtgtgaagagtttattgagctagttagtagtcctccggcccctgaatgcggctaatcccaactgcggagcacatgctctcaatccagagggtggtgtgtcgtaacgggcaactctgcagcggaaccgactactttgggtgtccgtgtttccttttattattatattggctgcttatggtgacaattgagagattgttgccatatagctattggattggccatccagtgacaaacagagctttgatatacttgttcgtgggttttgttccactcaccagtcgtacagttcatactctaaagtacattctgattctgaacaatagaaa

SEQ ID NO: 2776 - DNA, 750 bp, Echovirus
  30,strain Bastianni, complete genome.1
ttaaaacagcctgtgggttgatcccacccacagggcccactgggcgccagcacactggtatcgtggtacctttgtgcgcctgttttataccccctacccccacatgtactctagaagcaaggcaaacctgaccaatagtaggtgtggcacaccagccgcattttggtcaagcacttctgtttccccggaccgagtatcaataagctgctcacgcggctgaaggagaaaccgttcgttacccgaccagctacttcgagaaacctagtaacactatgaacgttgcggagtgtttcgttcagcacttcccccgtgtagatcaggtcgatgagtcaccgcattcctcacgggtgaccgtggcggtggctgcgttggcggcctgcctacgggttcgcccgtaggacgctctaataccgacatggtgtgaagagtccattgagctagctggtagtcctccggcccctgaatgcggctaatcctaactgcggagcaggtgctcacagaccagtgagtagcctgtcgtaacgggcaactctgcagcggaaccgactactttgggtgtttttccttttttcttctcttatattggctgcttatggtgacaattaaagaattgttaccatatagctattggattggccatccggtgacgagcagagccattgtttacctctttgttggatttgtacctttgaaccacaaagtcttgaataccattcatctcattttaaagttcaactcagctaaaagaaa

SEQ ID NO: 2777 - DNA, 751 bp, Human enterovirus sp.
  76, strain 04360/SD/CHN/2004/EV76, complete1
tttaaaacagcctgtgggttgtacccacccacagggctcactgggcgctagcacactggtatcacggtacccttgtgcgcctgttttatacaccctcccccctttttgtaacttagaagaaacaaacacacgatcaatagcaggcttagcgcaccagctaagtcttgatcaagcacttctgttaccccggactgagtatcaataagctgtgcccacggctgaaagagaaaacgttcgttacccggctgtctacttcgggaaacctagtaccatcatgaagactgcaaagcgtttcgctcagcacaaccccagtgtagatcaggtcgatgagtcactgcattcctcacaggcgactgtggcagtggctgcgttggcggcctgcctatggggaaacccataggacgctttaatgttgacatggtgcgaagagtctactgagctaggtagtagtcctccggcccctgaatgcggctaatcccaaccacggagcaggcgctcacactccagtgagtagcctgtcgtaatgcgcaagtctgtggcggaaccgactactttgggtgtccgtgtttccttttattcttatcatggctgcttatggtgacaatctaagattgttatcatatagctattggattggccatccggtgaactctagagatattatctatttgtttgttggttttaccaagttaaacatcaccagctacaccactcttctttatatcatattattgaacagtaaaaagagaaa

SEQ ID NO: 2778 - DNA, 751 bp, Unknown
  Description of Unknown: Human coxsackievirus A16strain FY18 from China, complete genome.1 sequence
ttaaaacagcctgtgggttgtgacccacccacagggcccactgggcgctagcactctgattctacggaatccttgtgcgcctgttttatgtcccttcccccaatcagtaacttagaagcattgcacctctttcgaccgttagcaggcgtggcgcaccagccatgtcttggtcaagcacttctgtttccccggaccgagtatcaatagactgctcacgcggttgagggagaaaacgtccgttacccggctaactacttcgagaagcctagtagcaccatgaaagttgcagagtgtttcgctcagcacttcccccgtgtagatcaggtcgatgagtcactgcgatccccacgggcgaccgtggcagtggctgcgttggcggcctgcctgtggggtaacccacaggacgctctaatatggacatggtgcaaagagtctattgagctagttagtactcctccggcccctgaatgcggctaatcctaactgcggagcacataccctcgacccagggggcagtgtgtcgtaacgggcaactctgcagcggaaccgactactttgggtgtccgtgtttccttttattcttatactggctgcttatggtgacaattgaaagattgttaccatatagctattggattggccatccggtgtgcaacagagctattatttacctatttgttgggtatataccactcacatccagaaaaaccctcgacacactagtatacattctttacttgaattctagaaa

SEQ ID NO: 2779 - DNA, 752 bp, Enterovirus sp.
  C99, strain K292/YN/CHN/2013, complete genome.1
ttaaaacagctctggggttgttcccaccccagaggcccacgtggcggctagtactctggtatcacggtacccttgtacgcctgacatcccattccctactgaaggagaagcaaattgcacgatatcaaaaaaagggggtacaaaccagaaccaccacgaacaagcacttctgttaccccggtgatattgcatagactgttcccacggtcaaaagcgattgatccgttatccgctcaagtacttcgagaagccttagtatctccttggaatcttccgatgcgttgcgctcaacactcgaccccggagtgtagcttaggtcgatgagtctggacgatcctcactggcgacagtggtccaggctgcgttggcggcctacctatggcccaaagccataggacgctagttgtgaacaaggtgtgaagagcctattgagctactcgagagtcctccggcccgtgaatgcggctaatcccaaccacggatcaggtgattgcaatccagcagttggcctgtcgtaacgcgcaagtctgtggcggaaccgactactttgggtgaccgtgtttccttttatttttattactggctgcttatggtgacaatcgaggattgttatcataaagcgaattggattggccatccggtgaaagtaaaacacattatttacctttttgttggatttactacattatccacgttcactctagatttaattcgcatagttcttttgactagaagattttaccaacataaca

SEQ ID NO: 2780 - DNA, 756 bp, Enterovirus sp.
  A76, strain 10-3291-2, complete genome.1
cagacgtgtgctcttcccgatgtgggttgtacccacccacagggcccaatgggcgctagcacaccggtatcacggtacccttgtgcgcctgttttatgcaccctccccctatgtaacttagaagaaacaaacacacgatcaatagtaggcttggcgcgccagctaagtcttgatcaagcacttctgttaccccggactgagtatcaataggctgtacccacggctgaaagagaaaacgttcgttacccggctatctacttcgggaaacctagtaccatcatgaagactgcaaagcgtttcgctcagcacaaccccagtgtagatcaggtcgatgagtcactgcattcctcacaggcgactgtggcagtggctgcgttggcggcctgcctatggggaaacccataggacgctttaatgttgacatggtgcgaagagtctactgagctaggtagtagtcctccggcccctgaatgcggctaatcccaaccacggagcaagcgctcacaatccagtgagtagcttgtcgtaatgcgaaagtctgtggcggaaccgactactttgggtgtccgtgtttccttttatttttatcatggctgcttatggtgacaatctaagattgttatcatatagctattggattggccatccggtgaactctagagatattatctatttgtttgttggttttaccaagttaaacatcactagttacaccaccttactttatattatactactgaataatagaaaaagaaa

SEQ ID NO: 2781 - DNA, 759 bp, Ljungan virus
  strain 145SL,isolate 145SLG, complete genome.1
ttgaaaggggggccctgcagccgatataggctgcagggttcccctggtggggtgggtacgtctctcgctcattgagtgggggcgtggctcaccaaccacacctggttggtccccaggttcatgcaataaccactttttgtaatctttacatctaagcttaattcacccactagaactggacgaaaccgcttggaataagtttggttctctcttgagtgtgttttgtgttagcataatttctgtctctagagtgctttacactctagtaggggctgtacccgggcggtcccactcttcacaggaatctgcacaggtggctttcacctctggacagtgcattccatacccgctccacaatagaagatgatgtatatctttgtttgtgaaatgctcatgaaacgtgtgtgtaggcgtagcggctacttgaatgccagcggaacccccctagtggtaacactagcctctgggcccaaaaggcatgtctctgaccattcaagtacacaaccccagtgatacacacatttagtaatggctcagtaatggacattgattgatcatcagacaattgttaggaggcctaggtatgacgggctgaaggatgccctggaggtacccgcaggtaaccttaagagactgtggatctgaccaggggcccaccatggaaacatgggtagaagtcttcggaccttgggttaaaaaacgtctaggcccgccccccacagggatgtggggtttcccttataaccccaatatcacatt

SEQ ID NO: 2782 - DNA, 788 bp, Antarctic picorna-like virus 2
  nonstructural protein and structural1
cgataaaccggttatggagaccttctttggagaataatattttaaccgttattagctctttagaacttaaaaggatgattaatttctttgcacttctcccgtgctttatagattttacctatatgtgagttaaccctctcactccaatttgccctgagtgggcataaataactgaacgacggtatgtactttgtacgattccgtgaccagatgaatatagctgatgagtatcttagactcagcttgtatcttcattattggttaaccaaccttaccctcattaataaactgaatcccatatgggtccgtttcttgtttcttttgaattattattaaatctgaaaaggtaacatgtagttgtgaggcatgaggtactaccttagaaaggaatagaatttttggtttctctccgtctagaacaatgacggagtctcgcttgaaccctttgttattattgatcgtcacacaccagtgacattccgagtaagcatttatattgactactttgggcttgcacgatcagtccccaggctgatctctccccatcttatatcttgaatatgactatactcattgatctctaatacttagttattacacagcgtttctcttgattggtttcgaaaacgtgcgagagttttatacgcctgttaacccaggtaccatttcgttgatgcgattatctcgcaaaagaaactttttacggccaacatgaatggttagcccccttatagcctagcgatattatttatttaattttcagttaggcatcacaaataattcccacc

SEQ ID NO: 2783 - DNA, 807 bp, Passerivirus sp.
  strain waxbill/DB01/HUN/2014, complete genome.1
ttgaaagccccacctggggggctttccctgtgctgcgacctgtcgctaaccaagaggcatgacctcaagattggacccacagtcgccacaggtgtccgttgatacgctccggacctaacccggataatgtaacatcaaattatttaagatttatgagcttatatactgttatgaacaccagtaaacatgttagattaagagcaaaacacccccctcgtcaattctagaagtccgcgagggatttagggtagcaaactaggaatctagatgcatattcttgttttaaaacccacgctgcaagtgatctgttcactctcatccaccctcagggtggtcagtgtggtgagtcatagcgacacctaacagaggctaacctagtaactcttgtgaagttcaacacgctgacaggattccacgtccgtttactgctagcattcccgctcagagggtggcccaagtaattggtgctctgagtgtgcgtgagctagtatcccgcgagggataggtgtgttgtaatgacacaagttggtgaaaggtaaagtgctttaggctagctactggcccattggctacgagtagacatgtgcaggaggtacccgctcatcttagcggatgtgacctgtagctaattagtcaatgctcgctgtagaaatcttttccccttttttcttttatatacagagtgattcgcatttgtattgaagattgtgtgcctagtgtatcttggtattatcagaggaagcaatttaaactggattttcaattaggaggattaaaaccttgttaactttttataagcattataaa

SEQ ID NO: 2784 - DNA, 833 bp, Cardiovirus Hu/SIDS-347/DEU/2010
  polyprotein gene, partial cds.1
tttccggcccaggctaagagaaacatataagttagatttgatccaaatttcttgacgaattcggaacgagatgttctccctcccttgccgcttgttcacacccataactctgattcggccctttgtgacaagccccttggtgaaagaacctctctccttccgacgtggttggaattaacatcacttccgacgaaagtgctatcatgcctccccgattgtgtggtgttttctgccctgctgggcggagcattttcgggttgagaaaccttgaatcctttcttttggaaccttggttcccccggtctaagccgcttggaatatgacagggttattttctttattcttatttctacttttatgggttctatccatgaaaagggtatgtgctgccccttccttctttggagaattcacacggcggtctttccgtctctcaacaagtgtgaatgcagcatgccggaaacggtgaagaaaacagtcttctgtggaagtctagagtgcacatcgaaacagctgtagcgacctcacggtagcagcggaatcccctcttggcgacaagagcctctgcggccaaaagccccgtggataagatccactgctgtgagcggtgcaaccccagcaccctgattcgatggttactctctacggaatcaaaagatggttttctcaagccctccggtagagaagccaagaatgtcctgaaggtaccccgcgtgcgggatctgatcaggagaccaattgacagtgctttacactgtcactttggtttaaaaactgtcacagcttctccaaaccaagtggtcttggttttccactttttattgaatggtaat

SEQ ID NO: 2785 - DNA, 963 bp, Saffold virus
  isolate SAFV-3_NL2007-2690, complete genome.1
tttgaacgcgggacctgcgatagtgccaacccacgtcttttcccactcctaacccggttcccacctcgggtccattgtaaggaccagatatatcatcccttgaatgctggctaatcagaggaaagtcagcattttccggcccaggctaagagaaacatataagttagaaatgattctaatcccttgacgaaatcagaacgagatgttctccctcccttgccgcttgttcacacccactttattgattcggccttttgtgacaagccccttggtgaaaggacctctctctttctggcgtggttggaattaacatcctttccgacgaaagtgctaacatgcctccccgattatgtgatgttttctgccctgctgggcggagcattctcgggttgagaaatctcagaacttttcctttggaactttggttcccccggtctaagccgcttggaatatgacagggttattttcttaatcttatttctacttttatgggttctatccataaaaagggtatgtgctgccccttccttctttggagaattcacacggcggtctttccgtctctcagcaagtgtgaatgcagcatgccggaaacggtgaagaaagcagttttctgtggaagtctagagtgcacatcgaaacagctgtagcgacctcacagtagcagcggactcccctcttggtgacaagagcctctgcggccaaaagccccgtggataagatccactgctgtgagcggtgcaaccccagcaccctgattcgatggtcattctctacggaaccagagaatggttttcctaagccctccggtagagaagccaagaatgtcctgaaggtaccccgcgtgcgggatctgatcaggagaccaattgacagtgctttacactgccactttggtttaaaaattgtcacagcttctccaaaccaagtggtcttggtttttcaactttattgaatggcaat

SEQ ID NO: 2786 - DNA, 992 bp, Foot-and-mouth disease virus
  - type A,isolate IND 64/2004, complete1
ttgaaagggggcgctagggtctcacccctagcatgccaacgactgctcctacgtcgcactccacacttatgtgtgcgcgcgcgggaatcgatggactatcgttcacccacctacagctggactcacggcaccgcgtggccattttagctggactgtgcggacgaacaccacttgcgcacctcgcgtgactggttagtactcttaccactctccgcctacttggtcgttagcgctgtcttgggcactcctgttgggggccgttcgacgctccacggtttcccccgtgccgcacactacggtgttggggccgtttcgtgcgagtcgatcgcctggtgtgcctcggctgtcacccggcgcccgcctttcatttttaccgtcgttcccggcgttaacgggatgtaatcgcaagatttgccttcgcccggaagtgaaacggcaacttcacacacttttgcccgttttcatgagaaacgggacgtcagcgcacgaaacgcgccgtcacttgaggaacacttgtacaaacacgtttcacgcaggtctccacgactgacataaatcgtgcaacttgaagctccgcctggtctttccaggtctagaggggtgacattttgtactgtgtttgactccacgcttggtccaccggcgagagttagtagcagcactgttgcttcgtagcggagcatgatggccgtgggaacccctccttggtaacaaggacccacggggccgaaagccacgtcctaacggacccatcatgtgtgcaaccccagcacggcaactttactgtgaaagccactttaaggtgacactgacactggtactcaaccactggtgacaggctaaggatgcccttcaggtaccccgaggtaacacgcgacactcgggatctgagaaggggactgggacttctttaaagtgcccagtttaaaaagcttctatgcctgaataggtgaccggaggccggcaccttttctcaattaacactgtaatct

SEQ ID NO: 2787 - DNA, 1000 bp, Watson virus
  polyprotein gene, complete cds.1
tacccccctgcatctcttgtctgaagcgtccaatatatttggtcaccgttttggacagattgtaacggttctacctgcatctcttttcaatgactggcaaagtgcccggattagatatattaagtctttcgtagttagcttaggcgtggtgaaaattgactttttatatgctaatcaatccaaaacaaatttgcttgcatttttgtcccaccttcgggtgggttctttttagaacaggtttatcaatgtgacaagttgtgcgacctctagagaaaaatgtcaaaatactcggttcagaccggggttttaataactacatatattgatcgattattgaattgtagtcctcgccagttactaccagatgacggaggatgcatctaatatcatcccaaattaggtgtctcccaactttttggtaattaatgatatatatgtgtgtgttaaaatgtataaacacttttaagtaagaaagtgtagcactttcaaggttgtactcgttttgatactggttattttaactttatatataatttcccttttccctcataagtacacccacgtaatcgtggtaccgctatgacatcatacgggggtgaaaagtgtggctgacagtcccggcaacgttaattcggcggcggtttcctgcagtgtattctgcctcgggctccggtatgtgttatctaagataacagtagggaaattatttgatagctggtaatccttatcttaattagtgcagcgacggagtctttagtgagactaccaaacacggctagcttaatgctaacggtccgatgaaaggctggcggtcggaggatcacatatctctaagatatggtcgtgcagtatccgcccggggtttaaggcaacgggtcccctaatgtccgaatggaatccttttcttttatggtgacaccagtactttatttcgataaagtgctttatatgtgttattcctttataatatttttttcaatttattatataaatatctatc

SEQ ID NO: 2788 - DNA, 1000 bp, Foot-and-mouth disease virus
  - type A,strain IND17/77, complete1
cgttagactgtcgttcaaccacctccagttggactcacggcaccgcgtggccattttagctggattgtgcggacgaacaccgcttgcgcaactcgcgtgaccggttagtactcttaccaccttccgcctacttggtcgttagcgctgtcttgggcacacctgttggggttagttcgacgctctgcggtatcccccgcgtgacggactacggtgctggggccgcctcgtgcgagccgatcgcctggtgtgcttcggctgtcacccggcgcccgcctttcatcccccctaagttttaccgtcgttcccgacgttaaagggaggtaaccacaagcttgataccgtcttgtccgacgttaaagggctgtaaccaaaagcttgtaccgcctttccccggcgttaatgggatgtaaccacaagatgaaccttcacccggaagtaaaacggcaacttcacacagttttgcccgttttcgtgagaaatgggacgtctgcgcacgaaacgcgccgtcgcttgaggaggacttgtacaaacacgatctacgcaggtctccacaactgacacaaaccgtgcaacttgaaactccgcctggtctttccaggtctagaggggtgacattttgtactgtgcttgactccacgctcggtccactagcgagtgtcagtagtagcactgttgcttcgtagcggaacatgatggccgtgggaacccccccttggtaacaaggacccacggggccgaaagccacgcctaacggacccatcatgtgtgcgatcccggcacggcaactttactatgaacatcactttaaggtgacgctgaaactggtactcaaacactggtgacagactaaggatgcccttcaggtaccccgaggtaacaagcgacactcgggatctgagaaggggactgggacttctttaaaagtgcccagtttaaaaagcttctatgtctgaataggcgaccggaggccggtgcctttcctttaactactactactttt

SEQ ID NO: 2789 - DNA, 1000 bp, Foot-and-mouth disease virus
  - type A,strain IND258/99, complete1
cggtggactgttgttcacccacctacagctgaactcacagcaccgcgtggccattttagctggcttgtgcggacgaacaccgcttgcgcatctcgcgtgaccggttagtactcttaccacttgccgcctacttggtcgttcgcgctgttttgggtactcctgttgggggccgttcaacgctctacggtctcccctgcgtaacagactacggtgatggggccgcttcgtgcgagttactcgcctggtgtgcttcggctgtcacccggcgcccgcctttcatcccccctaagttttaccgtcgttcccgacgttaaagggatgtaaccacaagcttgaaccgccttgcccgacgttaataggctgtaaccacatgcttgtaccgcctttcccggcgttaacgggatgcaaccacaagatggaccctcactcgggaagtaaaacgacaaacacactcagttttgcccgttttcacgagaaatgggacgtctgcgcacgaaacgcgccgtcgcttgaggaagacttgtacaaacacgatctatgcaggtttccacaactgacacacatcgtgcaacttgaagctccgcctggtctttccaggtctagaggggtgacactttgtactgtgcttgactccacgctcggtccactggcgggagtgagtagcagaactgttgcttcgtagcggagcatggtggccgtgggaacccccccctggtgacagggacccacgggccgaaagccacgtcctaacggacccaccatgtgtgcaaccccagcacggtaactttactgtgaaaaccactttaaggtgacactgatactggtactcaaccactggtgacaggctaaggatgcccttcaggtaccccgaggtaacacgcgacactcgggatctgagaaggggactgggacttctttaaaagtgctcagtttaaaaagcttctatgcctgaataggcgaccggaggccggcgcctttctcttaaaccactactacatta

SEQ ID NO: 2790 - DNA, 1000 bp, Foot-and-mouth disease virus
  - type A,isolate PD68/2011, complete1
gatggactgtcgttcacccacctacagctggactcaaggcaccgtgtggccattttagctggattgtgtggacgaacaccgcttgcgcacctcgcgtgaccggttagtactctcgacaccttccgcctacttggtcgtcagcgctgtcctgggcactcctgttgggggcgctccgacgctctacggtctcccccgtttgacgggctacggtgatagggccgcctcgtgcgagttggtcgtctggtgtgcttcggctgtcacccggcgcccgcctttcatccccccctaagttttaccgtcgttcccgacgttaaagggatgtaaccacaagctttggaccgtcttgtccgacgttaacgggctgtaaccacatgcttgtaccgcctttcccggcgttaacgggatgtaaccacaagatataccttcacccggaagtaaaacggcaaacccattcagttttgcccgttttcatgagaaatgggacgtcagcgcacgaaacgcgccgtcgcttgaggaagacttgtacaaacatgatctatgcaggtttccacaactgacacacatcgttcaacttgaaactccgcctggtctttccaggtctagaggggtgacactttgtactgtgattgactccacgctcggtccactggcgggtgctagtaacagggactgttgtttcgtagcggagcatgatggctgtgggactccctccttggtaacaaggacccacggggccaaaagccacgtcctaacggacccatcatgtgtgcaaccccagcacggcaactttactgtgaaaaacactttaaggtgacactgatactggtactcaaccactggtgacaggctaaggatgcccttcaggtaccccgaggtaacacgcgacactcgggatctgagaaggggactggggcttctttaaaagcgcccagtttaaaaagcgtctatgcctgaatgggcgaccggaggccggcgcctttcttttactactacttaactg

SEQ ID NO: 2791 - DNA, 1000 bp, Foot-and-mouth disease virus
  - type O,isolate ETH/4/2015, complete1
gttggactgtcgttcacccacctacgactggactcactgcaccgcgtggctaccctagttggatagtgcggacgaacaccacttgcgcacctcgcgtgactggttagtactcttaccactctccgcctgcttagtcgttagcgctgttttgggcactcttgttgggggccgttctacgctccacgttctctcccgtgcaacggactacggcgttggggccgctccgtgcgagcagctcgcttggtgtgtttcggttgtcactcggagcccacctttcacccccctccccctaagtaatgccgtctttcccgacgttaaagggaggttaccgcaagctcagtaccgccttgcccggcgttaagggcctgtaaccacacgcttacaccgcttttcccggcgttacgggatgcaaccgtaagatgatccttcaaccggaagtaaaacggaaacacgcacattttgcccgttttctgagaaacgggacgtcggcgcacgaaacgcgcagtcgctcgcgggacacttgtacaaacacgactcacgcaagattccacgactgacacaactcgtgcaacttgaaactccgcctggtctttccaggtctagaggggtgacactttgtactatgactgactccacgctcggtccactggcgggtgttagtaatggcattgttgtttcgtagcggagcgtagtggccgtgggaactcctccttggcaacaaggacccacggggccaaaagccacgtcctagcggacccactacgtgtgcgacccaggcacaacaaccttgctgtgaaaaccaccttaaagtgacactgatactggtactcagccattggtgacaggctaaggatgcccttcaggtaccccgaggtaacatgagacactcgggatctgagaaggggactggggcttctttaaaagcgcccagtttaaaaagcttctatgcctgaataggcgaccggaggccggcgcctttccattacctaccactacttga

SEQ ID NO: 2792 - DNA, 1000 bp, Foot-and-mouth disease virus
  - type A,isolate IND 43/2006, complete1
gcgcgtggggaccgctggactaccgttcacccacctacggctggactcacggcaccgcgtggccattttagctggaatgtgcggacgaacgccacttgcgcacctcgcgtgactggttaatactcttaccactttccgcctacttggtcgttagcgctgtcttgggcactcccgttgggggccgttcggcgctccacggtttcccacacacggcaaactacggtgatggggccgctccgtgcgagttgatcgcctggtgtgctcggcgtcacccggcgcccgcctttcatttttaccgtcgttcccgacgtttaaagggaggtaaccacaagcttacaaccgtcttgtccgacgttaaagggctgtaaccacaagcttgtaccgcctttcccggcgtcaaagggatgtaaccgcaagatacgccttcacccggaagtaaaacggcaacttaacacagttttgcccgttttcacgagaaacgggacgtttgcgcacgaaacgcgccgtcacttgaggaagacttgtacaaacacgatccacgcaggtttccgcaactgacaagaaccgtgcaacttgaagctccgcctggtctctccaggtctagaggggtgacactttgtactgtgcttgactccacgctcggtccactggcgagtgttagtaacagcactgttgcttcgtagcggagcatggtggccgcgggaactcctccttggtgacaaggacccgcggggccgaaagccacgtcctaaccgacccaccatgtgtgcgaccctggcacggcaactttactgtgaaacccacttcaaggtgacactgatactggtactcaaccactggtgacaggctaaggatgcccttcaggtaccccgaggtaacacgcgacactcgggatctgagaaggggactggggcttctttaaaagcgcccggtttaaaaagcttctacgcctgaataggtgaccggagccggcacctttccttttgaactaccaatttta

SEQ ID NO: 2793 - DNA, 1000 bp, Foot-and-mouth disease virus
  - type A,isolate IND 245/2007,1
tcgcgggaaccgatggactgtcgttcacccacctacagctggactcacggcaccgcgtggccattttagctggattgtgcggacgaacaccgcttgcgcatcttgcgtgaccggtcagtactcttaccaccttccgcctacttggtcgttagcgctgttctgggcactcctgttgggggccgttcgacgctccacggtctcccccgtctgacggactacggtgatggggccgcctcgtgcgggttggtcgtttggtgtgcttcggctgtcacccggcgcccgcctttcatttttaccgtcgttcccgacgttaaagggatgaaaccacaagcttgaaaccgtcttgcccgacgttaatgggttgtaccacacgcttgtaccgcctttcccggcgtcaacgggatgtaaccacaagataaaccttcatccggaagtaaaacggcaaccacactcagttttgcccgttttcatgagaaatgggacgtctgcgcacgaaacgcgccgtcgcttgaggaagacttgtacaaacacgatctatgcaggtttccacaactgacacaaaccgtgcaatttgaaactccgcctggtctttccaggtctagaggggtaacactttgtactgtgtttgactccacgctcggtccaccagcgagtgttagtaacagcactgttgcttcgtagcggagcatgatggccgcgggaattcccccttggtgacaaggacctgcggggccgaaagccacgtcctaatggacccatcatgtgtgcaaccccagcacggcagctttgctgagaaaaccactttaaggtgacactgatactggtactcaatcactggtgacaggctaaggatgcccttcaggtaccccgaggtaacaagtgacactcgggatctgagaaggggacaggggcttctttaaaagcgccctgtttaaaaaacttctatgcctggataagcgaccggaggccggcgcttttctaccaaaccactactgacttg

SEQ ID NO: 2794 - DNA, 1000 bp, Foot-and-mouth disease virus
  - type A,isolate IND 447/2005,1
cgcgggaatcgatggactatcgttcacccacctacagttggactcacggcaccgcgtggccattttagctggactgtgcggacgaacaccacttgcgcacctcgcgtgactggttagtactcttaccactttccgcctacttggtcgttagcgctgtcttgggcactcctgttgggggccgttcgacgctccacggtttcccccgtgccgcacactatggtgttggggccgcttcgtgcgagacgatcgcctggtgtgcttcggctgtcacccggcgcccgcctttcatttttaccgtcgttcccgacgttaaagggagataaccacaagctcaacgccgtcttgcccgacgttaaaggactgtaaccgtaagcttgtaccgcctttcccggcgttaacgggatgtaaccgcaagatttgccttcacccgggaagtaaaacggcaatttcacacagttttgcccgttttcatgagaaatgggacgtcagcgcacgaaacgcgccgtcacttgaggaagacttgtacaaacacgcttcacgcaggtctccacaactgacacaaatcgtgcaacttgaaactccgcctggtctttccaggtctagagggtgacattttgtactgtgtttgactccacgcttggtccaccggcgagagttagtaacagcactgttgcttcgtagcggagcatgatggccgtgggaacccctccttggtaacaaggacccacgggccgaaagccacgtcctaacggacccatcatgtgtgcaaccccagcacggcaactttactgtgaaagccgctttaaggtgacactgatactggtactcaaccactggtgacagctaaggatgcccttcaggtaccccgaggtaacacgcgacacttgggatctgagaaggggacagggacttctttaaaagtgccccagtttaaaaagcttctatgcctgaataggtgaccggaggccggcaccttttctcaattaacactgaaatctta

SEQ ID NO: 2795 - DNA, 1000 bp, Foot-and-mouth disease virus
  - type Asia 1,strain IND 491/97,1
acgcgggaaccgatggactgttgttcacccacctacggctggactcacggcaccgtgtggctatgatagctgaattgtgcgaacgaacgccgcttgcgcatcttgcgtaaccggttagtacctttataactctccgcctacatggtcgtcagcgctgtcctgggcacacccgttggggaccgttcgacgttctacggtttcccccgtataacaaactacggtaatggggccgcttcgcgcgagccgatcgcctggtgtgcagcggctgtcacccggcgcccgcctttcatttttaccgtcgttcccgacgttaaagggttgtaaccacaagcttggaaccgtcttgcccgacgttaacgggctgcaaccacacgcttgtaccgctttcccctgcgttaaaggggtgtaaccacaagatgtaccttcgcccggaagtaaaacggcaatcacactcagttttgcccgttttcatgagaaacgggacgtcagcgcacgaaacgcgccgtcgcttgaggaagacttgtacaaacacgatccacgtaggtttccacaactgacacaaaccgtgcaatttgaagctccgcctggtctttccaggtctagaggggtgacactttgtactgtgcttgactccacgctcggtccactagcgagtgttagtagcaacactgttgtttcgtagcggagcatgatggccgtgggaactcccccttggtaacaaggacccacggggccgaaagccacgtcctaacggacccatcatgtgtgcaaccccggcacggcaactttgttgtgaaagccactttaaggtgacactgatactggtacccaaccactggtgacaggctaaggatgcccttcaggtacacccaagtaacaagcgacactcgggatctgagaaggggactgggacttctgtaaaagtgcccagtttaaaaagcttctatgcctggataggcgaccggaggccggcgcctttcctttacctattactgttttc

SEQ ID NO: 2796 - DNA, 1000 bp, Foot-and-mouth disease virus
  - type A,isolate IND 88/2006, complete1
cgtgcactgccgggaaccgatggactgtcgttcacccacctacagctggactcacagcaccgcgtggccattttagctggactgtgcggacgaacaacgcgtgcgcatctcgcgtgaccgtttagtactcttaccactttccgcctacttggtcgctagcgctgcttttgggcactcctgttgggggccgtccgacgctccacggtctcccctgtgacggactacggtgatggggccgcctcgtgcgagttggtcgtttggtgtgctttggctgtcacccggcgcccgcctttcatttttaccgtcgttccggcgtaaaggggaggtagccataagcttgcaacgtctgcccgacgtaaaggctgtaaccgcaagattgtaccgcctgcccggcgttaaacgggctgcagccacaagatgaaccttcacccggaagttaaacggcaaacttgctcagttttgcccgttttcaggagaaatgggacgtctgcgcacgaaacgcgccgtcgcttgaggaggacttgtacaaacgcgattcattcaggttcccacaaccgacacaaaccgtgcaacttgaaacctcgcctggtctttccaggtctagaggggtgacattttgtactgtgtttgactccacgctcggtccactggcgagtgttagtaacagcactgttgcttcgtagcggagcatggtggccgcgggaattcctccttggtaacaaggacccgcggggccgaaagccacgtcctcacggacccaccatgtgtgcaaccccagcacggcaactttactgtgaaaaccactttaaggtgacgctgatactggtactcaaccactggtgacaggctaaggatgcccttcaggtaccccgaggtaacctgcgacactcgggatctgagaaggggactggggcttctttaaaagcgcctagtttaaaaagcttctatgcctgaataggtgaccggaggccggcacctttcctttaaacaactactttca

SEQ ID NO: 2797 - DNA, 1000 bp, Foot-and-mouth disease virus
  O,strain China/1/99(Tibet), complete1
tgtggggaccgctggactaccgtccacccacctacggctggactcacggcaccgcgtagccattttagctggactgtgcggacgaacgccacttgcgcaccccgcgtgactggttaatactcttaccactttccgcctacttggtcgttagcgctgccctgggcactcccgttgggggccgtccggtgctccacggttcccacgcatgacaaactacggtgatggggccgcttcgtgcgagttgatcgcctggtgtgtttcggctgtcacccgaagcccgcctttcacaagttttaccgtcgttcccggcgttaaagggaggtaaccacaagcttgcaactgtcttgctcgacgataaagggctgtgaccgcaagatgataccgcctttcccggcgttaattggatgcaaccacaagatgaaccttcacccggaagtaaaacggcaaattcgcctagttttgcccgttttcaggagaaatgggacgtctgcgcacgaaacgcgccgtcgcttgaggaggacttgtacaaacacgatctattcaggttcccacaaccgacacaaaccgtgcaacttgaaactccgcctggtctttccaggtctagaggggtgacattttgtactgtgcttgactccacgctcggtccactggcgagtgctagtaacagcactgttgcttcgtagcggagcatggtggccgcgggaactcctccttggtaacagggacccgcggggccgaaagccacgtcctcacggacccaccatgtgtgcaaccccagcacggcaactttactgtgaaaaccactttaaggtgacactgatactggtactcaaccactggtgacaggctaaggatgcccttcaggtaccctgaggtaacacgcgacactcgggatctgagaaggggactggggcttctttaaaagcgcctagtttaaaaagcttctacgcctgaataggtgaccggaggccggcacctttcttttaaacaactactttta

SEQ ID NO: 2798 - DNA, 1000 bp, Foot-and-mouth disease virus
  O genomic RNA,isolate O1Campos,1
gcgggacccgatggactttcgttcacccacctacagctggactcacggcaccgcgtggccattttagctggattgtgcggacgaacaccgcttgcgcacctcgcgtgaccggttagtactcttaccactctccgcctacttggtcgttagcgctgtcttgggcactcctgttgggggccgttcgacgctccacgggctctcctgtgtgacatctacggtgatggggccgtttcgcgcgggctggtcgtctggactgcttcggctgtcacccgacgcccgcctttcataggttttaccgtcattcccgacgtaaaagggaggtaaccacaagcttgaaaccgtccggcccgacgtaaaagggtggtaaccacaagcttactgccgtctttcccgacgttaaagggatgaaaccacaagacttaccttcgctcggaagtaaaacgacaaacacacacagttttgcccgttttcatgagaaatgggacgtctgcgcacgaaacgcgccgtcgcttgaggaggacttgtacaaacacgatctatgcaggtttccccaactgacacaaaccgtgcaacttgaaactccgcctggtctttccaggtctagaggggtaacactttgtactgagtttgactccacgctcgatccactagcgagtgttagtagcggtactgctgtctcgtagcggagcatgttggccgtgggaacacctccttggtaacaaggacccacggggccgaaagccacgtcctaacggacccaacatgtgtgcaaccccagcacggcagctttactgtgaaacccacttcaaggtgacattgatactggtactcaaacactggtgacaggctaaggatgcccttcaggtaccccgaggtaacaagcgacactcgggatctgagaaggggactgggacttctttaaagtgcccagtttaaaaagcttctatgcctgaataggtgaccggaggccggcacctttccttttataaccactgaatac

SEQ ID NO: 2799 - DNA, 1000 bp, Foot-and-mouth disease virus
  Asia1,strain YNBS/58, complete genome.1
ccacacttacctttgcgtacgcgcaggaaccgatggactttcgttcacctacctacagctggactcacggcaccgcgtggccattttagctggattgtgcggacgaacaccacttgcgcatttcgcgtgaccggttattactcttaccactttccgcctacttggtcgtcagcgctgtcctgggcacgcctgttgggggctgttcgacgctctacggtctcctccgcgtggcagactacggtgttggggccgcttcgtgcgagtcgctcgcctggtgtgctttggttgtcacccgaagcccgcctttcacaagttttaccgtcgttcccgacgttaaagggaggtaaccacaagcttgataccgtcttgcccgacgttaaaggctgtaaccataagcttgtaccgcctttcccggcgttaacgggatgcaaccacaagataaaccttcacccggaagtaaaacggtaacttcacacagttttgcccgcttttaccagaaacgggacgtctgcgcacgaaacgcgccgtcgcttgaggaagacttgtacaaacacgatctatgcaggtttccacaactgacacaaatcgtgcaacttgaaactccgcctggtctttccaggtctagaggggtgacattttgtactgtgctcgactccacgctcggtccactagcgggtgttagtaacagcactgttgcttcgtagcggagcatggtggccgcgggaactcctccttggtaacaaggacccacggggccaaaagccacgtcctaacggacccaccatgtgtgcaaccccagcacggcaactttactgcgaaaaccactttaaggtgacactgatactggtactcgaccactggtgacaggctaaggatgcccttcaggtaccccgaggtaacatgtgacactcgggatctgagggggactgggacttctttaaaagtgcccggtttaaaaagcttctatgcctgaataggcgaccggaggccggcgcctttc

SEQ ID NO: 2800 - DNA, 1000 bp, Foot-and-mouth disease virus
  - type A,strain IND17/82, complete1
gtccctgcgttgcactccacacttacgtttgtgaacgcacgggaaccgatggactttcgttcacccacctacagctggactcacggcaccgcgtggccatttagctggattgtgcggacgaacaccgcttgcgcttttcgcgtgaccggttagtactcttaccaccttccgcctacttggtcgttagcgctgtcttgggcactcctgttgggggctgttcgacgctctacggtctcccctgcgtgacagactacggtgtttggggccacctcgtgcgagccgctcgcctggtgtgtttcggctgtcacccggcgcccggctttcatcccccctaagttttaccgtcgttcccgacgttaaaggactgtaaccacatgcttgtaccgcctttcccggcgttaacgggatgtaaccacaagataaaccttcacccggaagtaaaacggcaacttcactcagttttgcccgttttcgagaaatgggacgtctgcgcacgaaacgcgccgtcgcttgaggaagacttgtacaaacacgatatatgcaggtttccacaactgacacacatcgtgcaacttgaagcctcgcctggtctttccaggtctagaggggtgacattttgtactgtgtttgactccacgctcggtccactggcgagtgttagtaacagcactgttgcttcgtagcggagcatgatggccgcgggaatccctccttggtaacaaggacccgcggggccgaaagccacgtcctgacggacccatcatgtgtgcaaccccagcacggcaactttactgtgaaactcactttaaggtgacactgatactggtactcatccactggtgacaggctaaggatgcccttcaggtaccccgaggtaacacgcgacactcgggatctgagaaggggactgggacttctttaaaagtgcctagtttaaaaagcttctatgcctgaataggcgaccggaggccggcgcctttctctaaccactaattaattg

SEQ ID NO: 2801 - DNA, 1000 bp, Foot-and-mouth disease virus
  - type O,isolate O/KEN/K60/20141
caactggactttcgttcacccacccacggctggactcacggcaccgtgtggccacttttctggactgtgcggacgaacgccgcttgcgcatctcgcgtgaccggttagtactcttaccaccttccgccaacttggtcgtcagcgctgtcttgggcactcccgtcgggggccgttcgacgctccactgtttctcttgtgtgctagactacggtgatggggctgtttcgcgcgggctgatcgcctggcgtctaggcgaacgcccgaagcctgcctttcacccccatcaccgtaagtaataccgtcttttccgacgttaaaggatagcaaccgcaagcttgctgccgtcttggccgacgttaaagggctgtaaccacaagcttgcaccgccttccccggcgtaaaatggatgtaaccgcaagaagaaccttcacccggaagtaaaacggcaacgttcacacttttgcccgttttgaagaaatgggacgtcagcgcacgaaacgcgccgtcgcttgaggatgacttgtacaaacacgatctacgcaggtatccacaactgacacaaaaccgtgcaatttgaagttccgcctggtctttccaggtctagaggggcgacactttgtactgtgattgactccacgctcggtccactagcgagtgctagtagtggtatcgtcgtttcgtagcggagcatggcggccgtgggatctcctccttggtgacaaggacccacggggccgaaagccacgccctaacgggcccgccatgtgtgcaaccccagcacggcaactttaccacgaagaccactttaaggtgacactgaaactggtactcaaccactggtgacaggctaaggatgcccttcaggtaccccgaggtaacacgcgacactcgggatctgagaaggggactgggacttctttaaagtgcccagtttaaaaagcttctatgcctgaataggcgaccggaggccggcgcctttccattaaccactactcaccac

SEQ ID NO: 2802 - DNA, 1000 bp, Foot-and-mouth disease virus
  - type SAT 2,isolate1
acgcgacactagggtgtcgccctagtgtcgcgtaccgaccgtcaccggttgaaacgctactgctcagacctctggctgtcgtacctctattaggcaggcaggaaccacccttttggggcccacgcgttttcgcccttttggggcccgcggtcaccacaccgcgcctccactaggctgacaaccgtgcctcctctaggctgacaactgtcgcccttttagggcctacgaccttcaagttacggctttagcgtccctcccgctgccgactcgcctacgtgaacgctagctcgtcacccgacggcctacctttcacccgggccgtcttaaagaacgtctccgtcttttccgacgttaatggattgtaaccaaacgctcttgccgtcgtgtccgacgttaaaggactgtaaccataagaaacaccttcccgcaggaagtaaaacatgcacaaagtaaccagttttgcccgttttcatgagaaatgggacgtccgcgcacgaaacgcgccgttgctctttgcattcttgtacaaacacgatctcacgcaggaatctcagaccaactcaacccgtgcatctgcaagtttcgcccggtctttccgggtctagagagacaaacagttgtactgagaccgactccacgattagtctactggcgggtattagtaacactcactttgcttcgtagcggagcacttgagcggtgggagtccccccatggtaacatggacccaccgggccaaaagccacgcttcatgcctcaagtgtgtgcaaccccagcacggcaatttgattgtgaaacctatcttaaggtaacactgagactggtacttggtttctggagacaggctaaggatgtccttcaggtaccccgaggtaacatgcgacactcgggatctgagaaggagactgggagttctgtaaaactgcccggtttaaaaagcttctatgcctgaataggtgaccggaggccggcaccttttccttttaccacaactaatttt

SEQ ID NO: 2803 - DNA, 1000 bp, Foot-and-mouth disease virus
  - type A,isolate IND 109/2006,1
atcggcagctcttgcgttgcactccacacttacgcccgtgcactgacgggaaccgatggactgtcgttcagccacccacagctggactcacagcaccgcgtggccattttagctggactgtccggacgaacaacgcttgcgcacttcacgtgaccgtttagtactcttaccactttccgcctacttggtcgttagcgctgcttttgggcactcctgttgggggccgtccgacgctccacggtctcccctctgtgacggactacggtgatggggccgcctcgtgcgagttagtcgtttggtgtgctttggctgccacccggcgcccgcctttcatttttaccgtcgttcccgacgttaacgggttgtaaccacacgcttgtaccgcctttcccggcgttaacgggatgtaaccataagatagaccttcacccggaagtaaaacggcaactacactcagttttgcccgttttcatgagaaatgggacgtctgcgcacgaaacgcgccgtcgcttgaggaagacttgtacaaacacgatctatgcaggtttccacaactgacacacaccgtacaatttgaagctccgcctggtctttccaggtctagaggggcgacactttgtactgtggctgactccacgctcggtccactggcgggtgtgagtaacaggactgttgcttcgtagcggagcatgttggccgtgggattccccccttggtaacaagggcccacggggccgaaagccacgtcttaacggacccaacatgtgtgcaaccccagcacggcaactttactgtgaaaaccactttaaggtgacactgatactggtactcaaccactggtgacaggctaaggatgcccttcaggtaccccgaggtaacatgcgacactcgggatctgagaaggggactggggcttctttcaaagcgcccagtttaaaaagcttctatgcctgaataggcgaccggaggccggcgcctttcttttaccattactaaacca

SEQ ID NO: 2804 - DNA, 1000 bp, Foot-and-mouth disease virus
  - type A,isolate IND 17/2009, complete1
ggcagctcctgcgttgcactccacacttacgcccgtgcactcgcgggaaccgatggactgtcgttcacccacctacagctggactcacggcaccgcgtggccattttagctggattgtactcttaccaccttccgcctacttggtcgttagcgctgtcctgggcactcctgttgggggccgttcgacgctccacggtctcccccgcctgacggactacggtgatggagccgcctcgtgcgggttggtcgtttggtgtgcttcggttgtcacccggcgcccgcctttcatttttaccgtcgttcccgacgttaaagggatgaaaacacaagcttgaaaccgtcttgcccgacgttaatgggttgtaaccacacgcttgtaccgcctttcccggcgttaacgggatgtaaccacaagacaaaccttcacccggaagcaaaacggcaaccacattcagttttgcccgttttcatgagaaacgggacgtctgcgcacgaaacgcgccgtcgcttgaggaagacttgtacaaacacgatctatgcaggtttccacaactgacacaaaccgtgcaatttgaaactccgcctggtctttccaggtctagaggggtaacactttgtactgtgtttgactccacgctcggtccaccagcgagtgttagtaacagcactgttgcttcgtagcggagcatgacggccgcgggaatccccccttggtgacaaggacccgcggggccgaaagccacgtcctgatggacccgtcatgtgtgcaaccccagcacggcagctttgctgagaaaaccactttaaggtgacactgatactggtactcaatcactggtgacaggctaaggatgcccttcaggtaccccgaggtaacaagtgacactcgggatctgagaaggggacaggggcttctttaaaagcgccctgtttaaaaagcttctatgcctggataagcgaccggaggccggcgcttttctactaaaccactactgacttg

SEQ ID NO: 2805 - DNA, 1000 bp, Foot-and-mouth disease virus
  - type SAT 1,isolate SAT1/KEN/K29/20141
agggggcactagggcgagaccctagtgtcgcgtaacgaccgtcaccggttgaaacgctactgctcagacctctggctgtcgtacctctattaggcagacaggaaccacccttttggggcctacgcgttctcgcccttttggggcccgcggctgtacgccgcgcctccactaggctgacaaccgtgcctcctctaggctgacaactgtcgcccttttagggcctacgaccttcaagttacggctttagcgtccctcccgctgccgactcgcctacgtgaacgctagctcgtcacccgacggcctacctttcacccccctccccctaaagaacgtttccgtcttttccgacgttaatggattgtaaccaaacgctcttgccgtcttgtccgacgttaaaggattgtaaccataagattcaccttcccgcaagaagtaaaacatgcacaaagtaaccagttttgcccgttttcatgagaaatgggacgtctgcgcacgaaacgcgctgttgctctttgcattcttgtacaaacacgatcttacgcaggaatcttagaccaacccaaaccgtgcaactgcaagtttcgcccggtctttccgggtctagagagacaaacagctgtactgaagccaactccacgtttggtccactagcgggtgctagtaacactcactttgcttcgtagcggagcacatgagcggtgggaactcccccatggcaacatggacccaccgggccaaaagccacgcctcgtgcctcatgtgtgtgcaaccccagcacggcaacttgtttgtgaaacacaccttaaggtgacactgatactggtacttgacttctggagacaggctaaggatgtccttcaggtaccccgaggtaacaagcgacactcgggatctgagaaggagactgggagttctataaaactgcccggtttaaaaagcttctatgcctgaataggtgaccggaggccggcaccttttcctttttaaaccactaaattct

SEQ ID NO: 2806 - DNA, 1000 bp, Foot-and-mouth disease virus
  (FMDV),strain C,isolate c-s8c1,1
acgacagtccctgcattgcactccacacttacgttgtgcgtacgcggggcccgatggaccatcgttcacccacctacagctggactcacgacaccgcgtggccattttagctggattgtgcggacgaacaccgcttgcgcttctcgcgtgaccggttagtactcttaccaccttccgcctacttggttgttagcgctgtcctgggcacccctgttgggggccgttcgacgctccacgggttcccccgtgcggcaactacggtgatggggccgtttcgcgcgggctgatcgcctggtttgcttcggctgtcacccgaaacccgcctttcataagttttaccgtctgtcccgacgttaaagggaggtaaccacaagcatactgccgccttccccggcgttaacgggatgcaaccgtaagacacaccttcatccggaagtgaaacggctgcgtcacatagttttgcccgttttcacgagaaatgggacgtctgcgcacgaaacgcgccgtcgcttgaggaagacttgtacaaacacgatctaagcaggtttccccaactgacacaaaacgtgcaacttgaaactccgcctggtctttccaggtctagaggggtaacactttgtactgtgtttggctccacgctcgatccactggcgagtgttagtaacagcactgttgcttcgtagcggagcatgacggccgtgggaactcctccttggtaacaaggacccacggggccaaaagccacgcccacacgggcccgtcatgtgtgcaaccccagcacggcgactttactgcgaaacccactttaaagtgacattgaaactggtacccacacactggtgacaggctaaggatgcccttcaggtaccccgaggtaacacgcgacactcgggatctgagaaggggactggggcttctataaaagcgctcggtttaaaaagcttctatgcctgaataggtgaccggaggtcggcacctttcctttacaattaatgaccct

SEQ ID NO: 2807 - DNA, 1000 bp, Saffold virus 1
  complete genome.1
tagcatcttcgcggtaaagaacaccccaggggtaacccctttgaacgcgggactgcgatagtgccaccccacgtctttcccactcctaacccgactcccacctcgggtccaatgaaaggaccaaataattcatcccttgaatgttggctaatcagaggaaagtcagcattttccggcccaggctaagagaaacatataagttagatttgattcaaatcccttgacgaattcgaaacgagatgttctccctcccttgccgcttgttcacacccatacatttaattcggcctcctgtgacaagcccctcggtgaaagaacctctctcttttcgacgtggttggaattaacatcatttccgacgaaagtgctatcatgcctccccgattatgtgatgttttctgccctgctgggcggagcattctcgggttgagaaaccttgaatcttttcctttggaaccttggttcccccggtctaagccgcttggaatatgacagggttattttctttatcttatttctactttcacgggttctatccgtgaaaagggtacgtgttgccccttccttcttcggagaattcacacggcggtctttccgtctctcgacaagtgtgaatgcaacatgccggaaacggtgaagaaaacagttttctgcggaagtctagagtgcgcatcgaaacagctgtagcgacctcacagtagcagcggactcccctcttggcgacaagagcctctgcggccaaaagccccgtggataagatccactgctgtgagcggtgcaaccccagcaccctgattcgatgaacgttctttacggaaccagaggatggttttcctaagccctccggtagagaagccaagaatgtcctgaaggtaccccgcgtgcgggatctgatcaggagaccaattgactgtgctttacaccgtcactttggtttaaaaactgtcacagcttctccaaaccaagtggtcttggttttccaattttattaactggcaat

SEQ ID NO: 2808 - DNA, 1000 bp, Foot-and-mouth disease virus
  - type A,strain IND81/00, complete1
aaagggggcgctagggtcgcacccctagcatgccatcggcagctcctgcgttgcactccacacttacgctcgtgcactcgcggggactgatggactgtcgttcacccacctacagctggactcacagcaccgcgtggccattttagctggattgtgcggacgaacaacgcttgcgcacctcgcgtgaccgtttagtactcttaccattttccgcctacttggtcgttagcgctgccttgggcactcctgttgggggccgtccgacgcttcacggtctcccccgtgtgacggactacggtgatggggccgcctcgtgcgagttggtcgtttggtgtactttggctgtaacccggcgccctcctttcatcccccctaagttttaccgtcgttcccggcgttaaagggatgtaaccacaagataacccttcacccggaagtaaaacggcaaccacactcagttttgcccgttttcatgagaaatgggacgtctgcgcacgaaacgcgccgtcgcttgaggatgacttgtacaaacacgatctaagcaggtttccacaactgacacacaccgtgcaatttgaaactccgcctggtctttccaggtctagaggggcgacactttgtactgtgattgactccacgctcggtccactggcgggtgcgagtaacaggactgttgcttcgtagcggagcatgttggccgtgggattccctccttggtaacaaggacccacggggccgaaagccacgtcctaacggacccaacatgtgtgcaaccccagcacggcaactttactgtgaaaaccactttaaggtgacactgatactggtactcaaccactggtgacaggctaaggatgcccttcaggtaccccgaggtaacacgcgacactcgggatctgagaaggggactggggcttctttaaagcgcccagtttaaaaagcttctatgtctgaataggcgaccggaggccggcgcctttcttttaccattactaaactg

SEQ ID NO: 2809 - DNA, 1000 bp, Foot-and-mouth disease virus HKN/2002
  complete genome.1
cgactcccgcgtcgcactccacacttacgtctctgcaagtgtaggaaccgacggactgtcgctcacccacctacagctgaacccacaacaccgcgtggccattttagctggattgtgcggacgaacgccgctcacgcatgtttcgcgtgaccggtcaatactcttaccactttccgcctacttggtcgtcagcgctgttgtagggcactcctgttgggggctgttcgacgctccgcggtctcccccgtactgagactacggtgttggggccgccacgtgcgggccgctcgcctggtgtgcttcgactgtcacccgaagcctacctttcaaagtaacaccgtcgctcccgacgttcaaagggaggaaaccacaagcttgcaccaccactcccggtgtcaacgggatgtaaccgcaagatgaaccttcacccggaagtaaaacggcaacttcacacagttttgcccgttttcatgagaaacgggacgtttgcgcacgaaacgcgccgtcgcttgaggaagacttgtacaaacacgatttaagcaggtttccacaactgataaaactcgtgcattttgaaaccccgcctggtctttccaggtctagaggggtgacactttgtactgtgctcgactccacgctcggtccactggcgggtgttagtagcagcactgttgcttcgtagcggagcatggtggccgtgggaactcctccttggtgacaaggacccacggggccaaaagccacgtccagatggacccaccatgtgtgcaaccccagcacggcaaccttactgcgaacaccaccttaacgtgacactgatactggtactcggtcactggtgacagactaaggatgcccttcaggtaccccgaggtaacacgggacactcgggatctgagaaggggattgggacttctttaaaagtgtccaatttaaaaagcttctatgtctgaataggcgaccggaggccggcgcctttccattacctactactaaatcc

SEQ ID NO: 2810 - DNA, 1000 bp, Foot-and-mouth disease virus
  - type A,isolate A/HY/CHA/2013,1
agggggcgttagggtctcagccctaacatgccaacgacagctcctgcgtcgcactccacacttacgtctgtgtgcgtgcgggaaccgatggactttcgttcacccacctacagctgggctcacggcaccgcgtggccattttagctggtttgagcggacgaacgtcgcttgcgcgcctcgcgtgaccggctagtactcttaacactccgcctacttggtcgttagcgctgtcctgggcactcctgttgggggccgttcgacgctctacggtctcccccccgcagcagtctacggtgatggggccgcttcgtgcgagccgatcgtttggtgtgcctcggttgtgaccttctcgtccgagtaaaggacggtaaccgcgagctttaaaccgcctttcccggtgttaacgggatgtaaccacaagatggaccttcgcccggaagtaaaacggcaacacacacagttttgcccgttttcatgagaaacgggacgtcagcgcacgaaacgcgccgttgcttgaggaggacttgtacaaacacgatttacgcaggttcccacaaccaacacaaaccgtgcaatttgaaatcccgcctggtcattccaggtctagaggggtgacactttgtactgtggttgactccacgctcggtccactggcgagtgtgagtagtagcactgttgcttcgtagcggagcatggtggccgcgggactccctccttggcaacaaggacccgcggggccgaaagccacgtctttgacccaccatgtgtgcaaccccagcacggcaaccttactacgaaaaccactttaaagtgacactgatactggtactcaaccactggtgacaggctaaggatgcccttcaggtaccccgaggtaacacgcgacactcgggatctgagaaggggactggggcttctgtaaaagcgcccagtttaaaaagcttctatgcctgaataggcgaccggaggccggcgcctttccctatctaccattacttac

SEQ ID NO: 2811 - DNA, 1000 bp, Saffold virus
  gene for polyprotein, partial cds,isolate: Pak-2325.1
agcatcttcgcggtaaagaacaccccaggggcaccccctttgaacgcgggacctgcgaaagtgccaacccacgtctttcccactcttatcccgattcccacctcgggtccaaagaaaggaccaattatttcatccctcgaatgctggctaatcagaggaaagtcagcattttccggcccaggctaagagaaacatataagttagatttggttcaaatcccttgacgaatttggaacgagatgttctccctcccttgccgcttgttcacacccacacatttaattcggcctattgtgacaagccccttggtgaaagaacctctctctttccaacgtggttggaattaacatcatttccgacgaaagtgttatcatgcctccccgattatgtgatgctttctgccctgctgggcggagcattctcgggtcgagaaaccttgaatcttttctcatggaaccttggttcccccggtctaagccgcttggaataagacagggttattttctttatcttgtttctacttttatgggttctatccataaaaagggtatgtgctgccccttccttcttcggagaattcacacggcggtctttccgtctctcgacaggtgtgaatgcagcatgccggaaacggtgaagaaaacagttttctgtggaagtctagagtgtacatcgaaacagctgtagcgacctcacagtagcagcggactcccctcttggtaacaagagcctctgcggccaaaagccccgtggatcagatccactgctgtgagcggtgcaaccccggcaccctgattcgatggacattctctacggaaccagagaatggttttctcaagccctccggtagagaagccaggaatgtcctgaaggtaccccgcgtgcgggatctgatcaggagaccaaatagcagtgctttacgctgttactttggtttaaaaattgtcacagcttctccaaaccaagtggtcttggttttctaattttattgaatggcaat

SEQ ID NO: 2812 - DNA, 1000 bp, Saffold virus
  gene for polyprotein, partial cds,isolate: Pak-3486.1
gcatcttcgcggcgaagaacaccccaggggtaccccctttgaacgcgggacctgcgacagtgccaacccacgtcttttcctactcccatcccggctcccacctcgagtccatagaaaggaccaagtacatcatcccttggatgctggctaatcagaggaaagtcagcattttccggcccaggctaagagaaacatataagttagaaatgatcacaatcccttgacgaaatcagaacgagatgttctccctcccttgccgcttgttcacacccacttcattaattcggccttttgtgacaagccccttggtgaaaggacctctctctttctgacgtggttggaattgacatcttttccgacgaaagtgctatcgtgcctccccgattatgtgatgttttctgccctgctgggcagagcattctcgggttgagaaaccttgaacctcttcctttggaaccttggttcccccggtctaagccgcttggaatatgacagggttattttccttatcttatttctactttcatgggttctatccatgaaaagggtatgtgttgccccttccttcttcggagaattcacacggcggtctttccgtctctcgacaagtgtgaatgcaacatgccggaaacggtgaagaaaacagttctctgtggaagtctagagcgcgcatcgaaacagctgtagcgacctcacagtagcagcggactcccctcttggcgacaagagcccctgcggccaaaagccccgtggataagatccactgctgtgagcggtgcaaccccagcaccctgattcgatgaacgttctttacggaaccagaggatggttttctcaagccctccggtagagaagccaagaatgtcctgaaggtaccccgcgtgcgggatctgatcaggagaccaattgacggtgctttacaccgtcactttggtttaaaaactgtcacagcttctccaaaccaagtggtcttggttttctacttttattgactggcaat

SEQ ID NO: 2813 - DNA, 1000 bp, Saffold virus
  partial gene for polyprotein,strain Finland 2008,1
cattttcgcggtgaagaacaccccaggggtaccccctttgaacgcgggacctgcgagagtgccaacccacgtcttttccctcttttaccccgattcccacctcgggtccaatgaaaggaccaaacatttcatcccttgaatgctggctaatcagaggaaagtcagcattttccggcccaggctaagagaaacatataagttagatttgatttgaatcccttgacgaattcggaatgagatgttctccctcccttgccgcttgttcacacccactgttttgattcggccccttgtgacaggccccttggtgaaagaacctctctcttttcgacgtggttggaattaacatcacttccgacgaaagtgctatcatgcctccccgattatgtaatgttttctgccctgctgggcggagcattctcgggttgagaaaccttgactcttttcttttggaaccttggttcccccggtctaagccgcttggaatatgacagggttattttctttattcttgattctacttttatgggttctatccataaaaagggtacgtgctgccccttccttctttggagaattcgcacgacggtctttccgtctctcaacaagtgtgaatgcagcatgccggaaacggtgaagaaaacagttttctgtggaagtctagagtgcacatcgaaacagctgtagcgacctcacagtagcagcggaaccccctcttggcgacaagagcctctgcggccaaaagccccgtggataagatccactgctgtgagcggtgcaatcccagcaccctggttcgatggtcattctctacagaaccagagaatggttttcttaagccctccggtagagaagccaagaatgtcctgaaggtaccccgcgtgcgggatctgatcaggagaccaattgacagtgctttacactgtcactttggtttaaaaactgtcgcagcttctccaaaccaactggtcttggttttccaattttattttatggcagt

SEQ ID NO: 2814 - DNA, 1000 bp, Saffold virus
  gene for polyprotein, partial cds, isolate: Pak-3164.1
caccttcgcggcgaagaacaccccaggggtaccccctttgaacgcgggacctgcgagagtgccaacccacgtcttttcccacttttaccccggttcccacctcgggtccaatgaaaggaccaagcaattcatcccctgaatgttggctaatcagaggaaagtcaacattttccggcccaggctaagagaaacatataagttagatttgattcaaatcccttgacgaattcggaacgagatgttctccctcccttgccgcttgttcacacccatgttttagattcggcctcttgtgacaagccccttggtgaaagaacctctctcttttcgacgtggttggaattaacatcatttccgacgaaagtgctatcatgcctccccgattgtgtgatgttttctgccctgctgggcggaacattctcgggttgagaaaccttgaatcttttcctttggaaccttggttcccccggtctaagccgcttggaatatgacagggttattttctaaatcttatttccacttttgtgggttctatccacaaaaagggtacgtgctgccccttccttctttggagaactcgcacggcggtctttccgtctctcaacaagtgtgagtgcagcatgccggaaacggtgaagaaaacagtttcttgtggaagtctagagtgcacatcgaaacagctgtagcgacctcacagtagcagcggactcccctcttggcgacaagagcctctgcggccaaaagccccgtggataagatccactgctgtgagcggtgcaaccccagcaccctgattcgatggtcattctctacggaaccaggaaatggttttcttaagccctccggcagagaagccaagaatgtcctgaaggtaccccgcgtgcgggatctgatcaggagaccaatcgacagtgctttacactgtcgctttggtttaaaaactgtcacagcttctccaaaccaagtggtcttggttttctaatttttgttgaatggcaat

SEQ ID NO: 2815 - DNA, 1000 bp, Human cosavirus
  isolate Cosavirus_Amsterdam_1994, complete genome.1
gctcactcctgtacaccgtgagtccgcgcagtgctgacttaacacttaagtaatgtttaggccgagaattacaccgctcggctcccacctttcaccaccgtgggattaacaggtggtcaatctgtattcctgtctttggttatgtcaaagcaatacggcatgtgcaatggcgcacaggcccaaggcggagatctagacctcacagattgtgttacagattaagaccatgctggatggtcacgttggagactgcatgtggcagtcttgaaacgtgtggtttgacgtctaaccattatagcagtgggtggagtactgcaaagatgtcaccgtgctttacacggtttttgaaccccacaccggctgtttggcacttgcaggacagtaggtttattttctttcagatctcttttctagtcgtgcatgttctgtatgcacgagcggagtgatactcccgctccttcttggacaggcggcctccacgtcctttgtggaactcaaggttgccaagtcactggtgtttgaagtgaagattagagaaacactagggagtttcatgtggctttgccagggattgtagcgatgctgtgtgtgtgtgcggaatccccctcgtggcgacacgagcctcacaggccaaaagccctgtccgaaaggacccacacagtggggcacccccagcccctccctacaaagctttgtgcaaatgaacttttgtttggcttttcttaagcttctctcacatcaggccccaaagatgtcctgaaggtaccccgtgtatctgaggatgagcaccatcgactacccggacttgtgagccttttcacagacgcatgtggtacccaagccccttccctacggggaaggggctttgctcactcagcacaggatctgatcaggagatctgtctccggtgctttacaccggggcacagatttaaaaatttcccaaggcctggcacacaacctaggggactaggttttccttttatcacaaagatgtcaat

SEQ ID NO: 2816 - DNA, 301 bp, Thrips tabaci associated dimarhabdovirus 1
  isolate Tamono1 RNA2R
acagaggaatcaaaatcgctgaatactcttctcacgcttacactattgctcattattgcatctcctaaggacttatacatttgactcattttctactctagatgcactttccctccctctccatttattcacttgcactgaaaaaaactaacagacttaacaagcctttccgtctctcttgtctggatgtttgcgtctgtgctcttggggttcagcgtcctgggtatattattaacaggagccctattcccactagtccaccgactgacaagccaagtcgaccccaaggagattgaacatc

SEQ ID NO: 2817 - DNA, 304 bp, Clitocybe odora virus
  complete genome, isolate C-Holm.1
ctgtaccttcacaggttcagttaagacgaaatctcgtctttctctcctcaattggagttctatctttagttcttcttctgagagggtcccccagtcttgggtaattaggtagttacatcctaattacttcggccgggagttaggtcaagtcttttgatttgatattgcctcctaaaccgagtgacacccgccatccttccaaaggtagccgcagcccccacctaggggaaactgtaggatagtctctagagggaagtgacgaatggtcgtcggcctggtttagtaacatacaaatcagagtccc

SEQ ID NO: 2818 - DNA, 304 bp, Plasmopara viticola lesion associated mononega virus 2
  isolate1R
tcaagcttcgcatgaccggtaagtagttattttcattatttaataaaacttaggattaaaaaataatctagactacaatatgaaagatatcgcagttaatcttagtgtgttagttcattctttggaattattatcgaaaattctttctcggatcgaggaactaaataagtcagaaaatgagctagatgcaattggaacagaagaaacatggaccttagtataaccatgcattaggtttattttataaaacttaggagcaaatcacaattatccttaagtctttttttgtaattgaagtgaaatc

SEQ ID NO: 2819 - DNA, 305 bp, Wenzhou pesti-like virus 1
  strain WZSS31331 polyprotein gene,1
caagtacgctcatagttctcgagccaaccacacgaaagctagttggggcctttaaatatggaaacttctagtcgtaaggtggggtatctcccctatgggtggtgaacgcttgttcgctgcaataatggtgagtagtctctagactaatgctacctagtgagacaacgattatctgtctcatgtaagatagcattagtttggcgagccaggttgtttgggagcaaccctctgtcgataaactacacagtctgataggacgcacgaccttgcccattatgtaggataaagaatggtctgtcaacaca

SEQ ID NO: 2820 - DNA, 308 bp, Vespa velutina associated menton virus
  isolate VVAMV/144I, complete1
gcgattggttcaatcgccaatttgagaaagctttaattgatctcgacgtcgcttctgtacccggtataacggccctttctaagtatggcactaccttaggagaaatcctagggtttgatggcaaggcttttgatgcagagcgcatcaacatatttagaatttatgttctagatagattcaaaactttactccgaggagaagaatatgcagatccaattaagttattcataaaacaggaaccgcacaagattaagaaaatagaagacaatcgtcttcgcttgattagtgctgtctctgtggtggatacg

SEQ ID NO: 2821 - DNA, 308 bp, Beihai tombus-like virus 4
  strain BHZY58951 hypothetical protein 1,1
actcagcgacaactcggaccataccgagagatagaaaaggagccagagtcggcttggtagacccccagaaggaaaactgggagtactgggaaacccggcaacccaccgtgaagaggtagattagccagataggaagacgtttggaccttacgaggttgagcgcacatgggcattaatgtcccggtgttagtgattacggagagatggacgcaatgtacccttagcgacatctagacgcctaatacgagaggcggagcgctatttagcgcagggggccagcccgagtgccgccttcaagttatcgagag

SEQ ID NO: 2822 - DNA, 309 bp, Hubei picorna-like virus 36
  strain SCM50248 hypothetical protein1
taaaacttcttaccccaaaggtaggatttgcaatcgcagtgaccctagcagcaaagttttataatttctatcccaaagatagacgaggtgagcgtactcgataacgtctcagccaatgttaacttggctacgtaataaagtcaatttgatgataattagcgtgttacaacgcgtaaacacaataataaaccaacaaatcgcagagcggcagttagctagcaatcaagtatccacagtgtgatatatgtcaaatcaaccaagatattttcctctagagatttccaccacagaagagatagcagagcaatc

SEQ ID NO: 2823 - DNA, 314 bp, Soybean leaf-associated negative-stranded RNA virus 1
  isolate1R
tcatccccaaattccccagactccccacacactgactgcgacagaggtatttaataaaacttaggagtaaactctagatgcgcacaatgacgacctgccaaaaagcattggaggatttggcgaatgtgctcgacattctaacgagatgtctctccgaggctactcaagagaagtctgatttcgaggagattcatactccttctgacgacgtgatttctatttcttctgctgagcaaagtgcattataaagggcaacgttggtattagattatataagtcgtgtattaaataaaacttaggagataaccgcaatc

SEQ ID NO: 2824 - DNA, 314 bp, Changjiang crawfish virus 4
  strain CLX8819 hypothetical protein1
tatcacattttatttaataggcttaatatatgtaactatttagtttacagcttattgaatacaatttccatttacctaatttataatcatattcgtattaaagtattcacatttttcatagaagatcttttgaattccgctctagatatttaagttttgaagtattagttttgaaagtaataattatcacgattagtaattccagtcttttcgactataagaaaccttcgaccgttcggtaatctctaaccaaagaagtcctgattgtatttaattttagggggtgtatttattcattcgtcaccatagtacaa

SEQ ID NO: 2825 - DNA, 317 bp, Thrips tabaci associated dsRNA virus 1
  isolate THR-E_DN240952
ccccagcaaagtctagatgctggataattgacatccgctgggcgaatgtcgtagtagctgagagcaggcaggctcgttttattaatgattttaagccagtcgtttttgcttggcacttgcaggttctattgaaccgccggcccctattggccaactccgctggtcggagcattttagaaattgtttttgattttcctgtcggctggtccgatgagagcggtcttttggccgattttgaatcatctgttttggatattatacgtatccgtattttaaatgactctgaggtcgatgacgagattaccgcgcagcagctg

SEQ ID NO: 2826 - DNA, 318 bp, Alternaria longipes dsRNA virus 1
  strain HN28, complete genome.1
ttttggaaaattatacgcctctgtttctagagtttcttttccaatgcccatagagtttggtacccatgctcctaagggtttgagccaattcggtaccgggggtaggtttaagcagcgggtttctactccctcccgcactgagttctaccggtattgtaggaccaggctggcaatccggaccagcctgtaggatggatatctcaaggcgatatagttgtcttttcgtggctatggggttagaacggcgctccctactcgatccgagggagcagccccattcgctgtacgcgagactagcacattagctgcctatatctc

SEQ ID NO: 2827 - DNA, 319 bp, Picornavirales sp.
  isolate H1_Bulk_28_FD_scaffold_4 hypothetical1R
aagtgttaacactcccctcctgtagcttactccacggttatacaggtagtattatagtgggtgcgtctgtgtgagtggtatgtagcagactaagattctttaccaattttgaggaaatggcctcgatcctaacccgattgtgttaccgcctccatcactttgccccatattacaggttatgcattgagtaccgcttcttgatgtatgatgactggaaggctttgtgagatctcgttctcctgacaaacaggttgttatagagttgggcgtccccccgaaaacaaaaacggcaactggtgagctgactgatctagaaagc

SEQ ID NO: 2828 - DNA, 322 bp, Beihai sipunculid worm virus 5
  strain BHNXC41492 hypothetical1
atgggcagctatatattagctgcacggtagatacttttcaagcaagaggccagtgcagaccccttggtcgtatccagattttgcctagtgcgttaaaagagtccatcctcgccgggtatccagattaccggaggacctcatcagcacgtctgaagcggaatatatacgatagatcactagagacaagtctagacggatcagttagttggatttctctgcagtctgtaacgacgagagtgccagcagagctgagcgacctctattgatcgctgtgcacacccccgaactgacaacacgagatagaatcacttttcggcccatc

SEQ ID NO: 2829 - DNA, 323 bp, Wuhan insect virus 20
  strain WHCCII13322 hypothetical protein 1,1
acgggctctgctccgactctggttttgaatccccgttttcaattttggggttaccagagattgtggtgcgcagtggggctatccctaggaaaactagctctagaattagtttcttgaatcagtttagtttaggattagattttagatctcctaacccttctttacacaacgctttagtagcagtcgagagacgtgtctttactgtaggcaaaggcacggagattattcttcccccgcaacctgaggaaaacatttttcacagcttagattactttagagatgctgtggtgagggaagtcggcttttgtaagacctacaccccc

SEQ ID NO: 2830 - DNA, 327 bp, Blattodean nairo-related virus
  OKIAV321 segment M cRNA sequence.1
cacaaagaaacttacggctcagcaaccaaaactgtgctactggatcattgtttgtgtattaagtgcttcatattcatatttggtaatgtggtgtatctgcatacgtcactttatctccatttgcattatattatctttcattattgtcttctcttagatataggtatagttagtaataagctgtgaaattctagatagttgaactatagtaaactagtagacattaagaattaaatcactgacaagtagcagataaatcattttttcttaaactggaaagtaagtaaatacccacaagcaactgctgacagaatttgatgagtgaag

SEQ ID NO: 2831 - DNA, 336 bp, Cragig virus 1
  replicative protein and structural protein genes,1
aataaattaattggtcctaatttattttctttttctgtgtccgaccagcacaaatgattttgtcgttttgacaataattaaacaacagttactctagaacgtcatctaggaggagttctatgttctaacggttctcattatgaggcgcttgaattttggaataacctttgttacagttctctgagtttttgcacgttttttccattaaaaacgtgcagcctgtgttaggtttataaacactagggaaacgccccgaaagtgcgacttgcagataattgttgtcatgctgcattgtatttttacaacacggcttatatagccttaaccgaagattcc

SEQ ID NO: 2832 - DNA, 342 bp, Avian avulavirus 20
  isolate AAvV-20/great black headed2
tcacaatatcttcagaagattataacggcttaacaacaagaccatctaaatactatattacatgcatctatacgattcctttaaaataattaaattaatgacagtgacacaatattacaaaataatcttctagataatcctaaattgccaccctggaccaatttctcattctgatttaacagtgataccttcaccatttgtttttgtaatgatctagtatcagattctattggttttgagctttccaataataaagattttgaaccatcagttctaaaaaaaaccttttgggtgggtgaaatggaacttgggggcgacccctagcctgagaatatcccaaca

SEQ ID NO: 2833 - DNA, 344 bp, Dicistroviridae sp.
  isolate sru103dic1 genomic sequence.2
tcttgctatcttaggtaaaatgagaggttaaaataagttagtagtgctatttcggataagatgttagttatttaactttactgcttaggatgcatcgtggcagccccataaaaatccagagcccctccctcgtttctagaagattaagtcgtcaatagaaattaaataatagacttgcgtcaaaatataatgataataatcctagtaatagatctgataatacatataatggtagtttaagtaatgaagatgctccccctactccccaaaatgcacaagaacaggtacaaataacaacttttgaagctgatcttgctgtattacccgagcatgtcccaggagaa

SEQ ID NO: 2834 - DNA, 356 bp, Avocet picornavirus B
  isolate MW14 genomic sequence.1
cgcatatcctctccctcttttctcccttccccctccccgacctttttcccctctacggcctcggattgcggactgatatgacgcgcctgacgtggaattcaggaattctggaactgggggacttcgcccaagctgtgaaccggattaccgatgtagctccttgggtgcctcagggaagggaccagtagttctagagcacatgtgaagcactgacaaggggactgcgttgcatatccccgaccccggactctgtgtgatgatgctggattgccgctagcacagagaaaccacccttttagggctcgcagggcagtgtgtagcacctagtttgggaaagctaggctggtgtgtactgg

SEQ ID NO: 2835 - DNA, 357 bp, Hubei tombus-like virus 6
  strain WGML12775 hypothetical protein 1,1
gggtgcccaacagatgccacaggtcaggggtgtgaatggtctaaagctattgaagagttcaattgtgttcttatcaatgggggtcatagggtgacctttgaccccattgagaggaagcagttgaataaaagctcggaattcccccctgatcgtttgcagtgggaaaccactgttgggatacccaaggaacgtaggtatgttagagtgtctagaataggtcgcgatgtaaatattattccatttaataatgatatacgaactttgcaacgggcggtcgttgaacgagtcttcactgtgaaaagtgatggtgagttttgtcggccaccccgtccagctaaggatcatttccaaaacgta

SEQ ID NO: 2836 - DNA, 367 bp, Hubei sobemo-like virus 38
  strain QTM27202 hypothetical protein 1,1
agagatcgagcgaaacgggtttcgatatatcggaaaaaccgatccaatcagtagaaatgtcggtgcttatggaacaaattcttacattgcgcaaagatttcctgattttgacagaatcgataagctcgaagagtactgcccgccagagttccacacacagcggcaaaacaacacagcagaactccgaagtttcgcagtccattcaaaaataagacgcgaattgttagataggatacaaccgttgacgacccagcaattcaattcggttttggatcgaagcgaggacgtgttttcaaaaattagagttgagatttctgatgactttctagattttgataaggttttaaaaattgtgctatctcttaat

SEQ ID NO: 2837 - DNA, 382 bp, Apodemus agrarius picornavirus
  strain Longquan-Rl32 polyprotein1
tgatgagggtcgccatcccggttgtggtgacacaacgggcgtccctgcgctggcatgaggcctctttgaggctggagaatcgggatcggtaaccgaagagccccgtgagctagggttgactcctccgcctccctgaatgcggctaatcccaacccatgagcatccggtggcaatcccgccacaagggtgtcgtaacgcgtaagtcgtgggcggaaccgactactttgggaaggcgtgtttccattttatccattctactgtggttatggtgacaagttataaatctagatctatagcgtttgttgagagatatccaacaattgaacaaactcgcacagttcttttctttggaaggcttttctttggaaggcaaacagtgaaa

SEQ ID NO: 2838 - DNA, 384 bp, Salem virus
  complete genome.1
acgcttctagaaggtctccaatcactactgttatctttcaatcagtctaatcaccgaacttgattgatttgcttttatcattaaataactcttaaaatcactaaaaaaaacctaggactcaagagaacgagacccaagacagtccgacaagcccggaaccctcccaagagaggaacgaaagccgacaccccgagaacccaccaagatccaacaacaaccgagccacacccaccacaccgccagaaatccagacaaagccccgaaacaatcacactcctagccatccacagcggcctccttcccaacgaattggaaacgccacccaccacgtgtcatccctgacacttgggcataggcaatcaactcactccataagtagtaaat

SEQ ID NO: 2839 - DNA, 384 bp, Wenzhou picorna-like virus 35
  strain WZRBX39547 hypothetical2
ataaaattcagtattgaacgtatgggtgtcctcaagccaccgttgtgacaggcgcctacttggctgaactgaatgagtgcctaaaattgtgttgtttacgcaaaccaactagggtattggtggcgagccaattacctgaaagctctagatgatgttgagcgttgttcatttgaggagtacccaaatctttgtgtacgagccgttcctaggaacgttgtcgagcacacattgatgtagggcccgattacaggacatgccattgactaatcagagtgagtacaattttaggggagtccactgtaagttcttttcggcccagtccccgtgtagacgcaactcacaaaacatgttgacaatgctgctttttatttgccctcccttctt

SEQ ID NO: 2840 - DNA, 388 bp, Hubei levi-like virus 11
  strain WHWN53995 hypothetical protein1
gccgttaaggccccgctgcgctgcttcttcggacgctgcgtactgctttgcagatcccggcctacacccttctcggaggtatgtatgccgtatagtcaccgctgcaggttctctgctacgggccgtttactcggcggtgtatttcttttacacttgacttgaggtcacatatgtccaaggacgagctcctccagctgctttatagtcagcgcgaatctattcagcttatatctcctaacgggggtcgtcaagacctttctgtcggggatatcggtgatgcttcgcgctattctgtttcgcaactgcagggctttactttggcttatgcgagcgtgctttatgaacacgctgacgaactcgtcgcctctagacttcttaaggaatcgtg

SEQ ID NO: 2841 - DNA, 391 bp, Avian metaavulavirus 21
  isolate APMV/dove/Taiwan/AHRI33/2009,4
cttgtttagttaagttgaacggtgatggttacattcctcattgcacattgactcataactggcgttggtacaattaatctagttgacgaaagaggtcaactagcgtactctaacactaatattaatataaacacttaagcttaggctcacatctagatgtgaagaagcagtcactttaaattcattcaattaaattatcaattgatactgtactgaggcataaccacttacaacttagtgcacagccttattgctttacaatctgcagatagtggtaacttaggtcgaaatttagatttaaatgcataagtgctatactgttgatttaataaaaaaatgggggagaccaccaataaaacagcaactgccgctgctagaagtagacctaatc

SEQ ID NO: 2842 - DNA, 399 bp, Marine RNA virus
  BC-3 non-structural polyprotein and structural1
ttctagaatagctagattttaacctatgtattattattgttttatgtttatatatctgaccatcatgtccttaaactgttcggaggcgcactcatgtgtcaacgtgacttatgtgaaaccaaaaatgagctgtacatactgattacggcagtcgaccttagtgtctaccccttaaatagactgacgcttgtgtatatctgggaagcataatgcttgtggctatttagctgcggaggtcctaccactccaccaatgtagagacaggacatcgctctgaggtgagctttgtacccgtgtaaataaaaataccttaccaactttactctaaaacaaaagtctgtggaggactataaactctacacttatgtgccccaatctggagaggttgggatttcacaa

SEQ ID NO: 2843 - DNA, 399 bp, Hubei picorna-like virus 14
  strain QTM26191 hypothetical protein 11
acttgcaactaatcttcgagagtctaagaataagacactaatggctggtcaatccgctaataacggtctacagtacggtgaaactttttctacatcactattctggtaagaatgtaaatatacaatttgtcttatagacacctcaatgtgaaatgacgaacgaaaataacattgttgtattaaagcggctctttttagagttactaatcaagaacgcttgttggcagccccaatgaattctagatgttcaaatttgctaacgattaggctgttgttagtgaataaattaagcctgcgaattttataactgaaactttaaagcaagaacaacgacaaattttaactttcgcatcagaaggtgattccaaccacactaatgtgatagcaaaaagtttgcaa

SEQ ID NO: 2844 - DNA, 403 bp, Botrytis porri RNA virus 1
  RNA 1, complete genome.1
gcaaataaaagagctgccttttgaagccttttatttgtaaggaaaatttatattgatcgtcattcaacgatccccgctcgggttagaaagcaccacaagcgcagtgacgatcgcttgtgagtagtagtcacactagatggtaaattctatttggaacctcggacactctcaaaccgccttgtcaggatatcagcggatgtgaatagacgtgtggaacacaacgtgcccaccacatcttcaactgctcctgttagtgtataaatcagaaggataggtaaaccgagatctctagagaagaggctacctggcactgctgacgggccgtagtatactacgatatcgggaggaattgaagccttctgtaatcccccagtacccaggctctctagggtaaagtgagaga

SEQ ID NO: 2845 - DNA, 411 bp, Hubei tombus-like virus 15
  strain WHYY21098 hypothetical protein 1,1
gaatgccgcaccttgactgctgtctgtacgtccggaagacctggacccaacaaaaccttgccaggtagcagtgttaacgccaaggaatgcgtttgtcattgtaaacgcagaaccaccaaattattcaactacagcattccagagttgaacgacagctatgtttggacgcacaaagggtgtgtgtgtaacgaactggtggctctaaaacaacggcaccaactcgatgatggtctcagatatgtttcaaagtctaacttgtctagacatctcagaccgttcatcaagacggttagtccctgctcggaagatactgtgattgcccacagtgcaggcgctaagcgtaaactccttctctcggccaaattaagccttgaagtctatcctattcaacctgaggatggcgcggtgaaa

SEQ ID NO: 2846 - DNA, 416 bp, Riboviria sp.
  isolate plw155urn1 genomic sequence.1
ccccgcaattgtcccaaagattgcggggagcgagcctcggtaatatatttggattagcatatacggattatatttatgtgcatatagaaggagataaattgactgacttaatatttcaaaatgctttactagacattccggattttacaacagtatcattatttcaacacgaaatatcatctaccgagagtggatacacattccaattctgtactgttggttatgcttcctattaccagcatagtagctatttcgtgctatttcaatctaattccgataatttccttccattaattaaagattataaaagtagttcagagtttgcagatgtatctcgcacaatttatgattggtacaaccctacatacgatgatctagactactgtagcttttataaagttgaccaaattaataaa

SEQ ID NO: 2847 - DNA, 422 bp, Achimota virus 1
  complete genome.2
atgagtgctggccagagcattctcaagactcctccaccaggtccacagaacacagaaccccgaatgacaaagaagaggatttgcatcaccccactggacagaaggaaccaactcagatctgctacagcatccacaatcatcacaaagtcagcaatcgcatccttctctaaaaacaaactctctagcttgctcaaaattgcccaacagttaatcaatcatcccgtagatagatagatttccatgctaatacgcttaatgcatttaagaaaaaacttgaggatatatagtctgtatgattgaataaatgagatgggatgatcatcttagaagaaaagaagaatgggcccggaccccataaatgtccggacactctagattccaacatggctctatcaactcatcttagacaagcctattctgtg

SEQ ID NO: 2848 - DNA, 428 bp, Tesano Aedes virus
  16GH47 RNA, complete genome.1
ccacctctgatatacaggtgaaagttgtatatcaaaagaaatttttattttagttttaatatctagttcacagggctataacctaccccttattagtaacaaaatataaaaactcggtacagaccggggtattgatttgatgactttaagatggaattttgtttagtttacggaaggcccgtagctcttatcaatccccctaagagttacccctattctagaattccattttaattttatcaataggtatggataaatattagatagtaaggcaaggtacgtatcttatagaaatgttagtaagtacggagaagtacgcgactctagttgaacgataaatagcatctcgagcttaccagtagccctggcgttaacaatagaatagctaaaggcttctcctgaaagcaaccgctactataagatagcgt

SEQ ID NO: 2849 - DNA, 436 bp, Hubei diptera virus 11
  strain SCM51501 hypothetical protein 1,3
atctaacaacattcaatttactaaccatagatataagatacatttaaagaaaaccgtagtaaaagtcaaatacagtatacatcgaaatggacccagtatattttactaccacttgtcccagatgtggtgaaggaattaaatatataagggttgaaaaaccacttccaactacacaaaatcaacccaaacagacaggttaaatcattacaaatttttcattttgatattaatcccaatttatttttacagaagcttttacatttctaattatttattatttattgaaacatatatgtctgttcttatcccatctcttatttctttatacatctacttttggacataattaaattattattcagttatttatcattttaacacagagattatgttctagaccctttaatatttaaacaaaaccgtagtaaaagtcata

SEQ ID NO: 2850 - DNA, 440 bp, Salari virus
  isolate OTU77 RNA-dependent RNA polymerase gene,1
agaacaatcccaaaagctgtactgcctgtgccttttgtattggctccgaagtctgaattgcatgaccaaacatttgtacctttccctatgtcaactgctggtggtaaatgcgaccctgtcatgagactttggcaagcagcatctagaaattacaatcacagacctgcagactatctagcgtcaaagagagaaaggtttgacgagatgtatgaagatgaccctgaagagcagcggaagatacaggaaaagaataaagagaagaggggccttgcccatcgggctaacatcaaaggagaattagctgaagaggacctcaggctgctagcactagatggtgtgtttgggaagaagtttatgagcgatatggaaaagcaagtgaaatatgaagatagcaaaagaccttggaattggaacactgactgcactgatatagatgcttt

SEQ ID NO: 2851 - DNA, 445 bp, Blechomonas wendygibsoni Leishmaniavirus-like RNA virus 1
  strain1
gtagcctatagccttgctcctcttaaggagggctagtatcatgagcgtcaattcatgacctgatatagctttatgcgaaaatatcggggtcaacaatggtgtattctgtgtgacggtagctccggtttccgtaattctagatagttaataactctagttcccttgtggttagtcgttgtaagcgctggcatagatgcactcaaacgatcagacgccgagtcggtgcaaaaggagtggtttggcagccacactctatagaccgattcattctgactcgcctattgttgactatctactactaccaatcgctattgctctcgtcatcctatcagttcgacttgttagtgtctactctcgctctagactaacaaggcttctagttgtttcaactagattcatataagaactgatctgtgacatccaactttcgttattcatcatcaaa

SEQ ID NO: 2852 - DNA, 448 bp, Culex mosquito virus 2
  strain CMosV2/Santa Cruz, complete genome.1
atcaacacaaatcgagaaaaaaacttttataatggcttctaattcagtactaaaaattagcactcatctggagatgaagtttagagaacctcctagaactagtaaagatgtattaagagccttagaactcattaaagacaattataatgggtttccggagaatttagaaattataatggtgttttatgtattgtcgggattcacatgtaaatatttaggaaaattaggtcaattctatatttataaaagtacattatctggagtatttaatggtaggtgatgggatacgattattcataattatttatcctccgggaaatgtctagataaatttttctgcactagatacagtagctgcaaccattagattttaacaagatgagcgtgaaaaaaacagataacacaaatcatattatatcatcttattataattcgaatctatctgaac

SEQ ID NO: 2853 - DNA, 455 bp, Hubei permutotetra-like virus 3
  strain spider127212 RdRp and1
ctagaaatactgccgtactcttgctgactgttagtagaagtgttttatgtgtgacggacggatgtcaaacaaaggttgacatctctctcggcacattccaatacttcgctaaaccccctcctacaacacaatgtattgagcttgttacatctaccgctctagggaaaacagagtgttcccttcctccacactgtggagaagctcaatatgctgaggtcgacagtggatggttttctagagtcggagtctgtcaaggacttggactgacgaaaactactttgcaaggagcaccaactctaattggcaactggctttctgtatataatgttaccattactcgtattcccccagtcatagctgatgaacttgtagtcctttttgaccagaaatccaacgtgtactctttagtaccgcatttctatgttgagacatttttcattaaaacccaagatgga

SEQ ID NO: 2854 - DNA, 458 bp, Picornavirales sp.
  isolate ltt163shi1 genomic sequence.2
aataaaatataaccgttatgtagttgaaattgaggaaacgatagtaggctgtggtcttgtccaactaagatcgggtagcaattttattgtccgattatgttgtccaaggctccttacgccgattactcataacactatattttattataattttaaggtttaatgtgatcttgcacgataaatgttgatgtgaaaacgtcgtgtattgctattaaacttgcgtacctatttaggtttactcatcaagatcgcggagtgcagcccactcgaaatctagatacatcaactattctattagattaggtagtcaatagtttagtataatattacctgcaaattttgaacaaaatactataacaaaaacgcaacaacaaatattgtctttttcctctgaaggagaatgtaacaggtctggagtattaccagatagagttagtattccacgccaatttctgtcg

SEQ ID NO: 2855 - DNA, 459 bp, Culverton virus
  RNA-dependent RNA polymerase, nucleocapsid, and1R
atcttcacaggttgcccctaacatatgacgactggcatgattaatgacaagagataccttagttttaagagtttttagagttagaccaaatgtaaccacattccatgaagtactattaacattaaccttagacataagttatgtattatttttctatttgtagttcttaattgctttttaaaaactcacagataaaaaaactcggttaatcaaagaaaacccacctgaaagacaaacaatctacttagattatgtctgctatttttcccaagaattcgaaatttgtatgcatattaccctaatcaggtttttacactagtgacgagtataaaagctctagactaataagaggaccagcccgatacatagatagttttaacagaggttgatggtcgagggagtatgatataataattcagctctcaatctatatcgtagtgatgatatgatccattcaca

SEQ ID NO: 2856 - DNA, 463 bp, Darwin bee virus 8
  isolate NT-7 nonstructural polyprotein and1
aaaggactgttgtaatacagttgaatcaataagttgtgaatttgcagattgttgagtattcgttgtctcaatcttgtttgaggtgcttctgtggtggtcgcacttctagagtagctaagggtttgacacacatttaaatttcaagatcatgctagtagctgtcgagtcatttttccaaagaaagtccatgggatttacgtgatggacatgggtatgactccggagacggtgtaacgaggcagtaaagatcttgagatggcgtgtgtgaatgactccgccttgcattaatcacatgaaaagaccgttcggatagcggagctgacagtaggcacgtgatgattaatgtgactgtggaaacttagcgcgagattacttgtattctcaatctgctttaaagcaatgatgtgattcaggtgttaaaccaacgattgcatcgtgtgtaattagctagattggaagtggt

SEQ ID NO: 2857 - DNA, 464 bp, Plasmopara viticola lesion associated tombus-like virus 1
  isolate1
agagcccgtgagatattttcactcctaatagtagccatgaaaccttgattggtggattggcgaagctaggggcagagatcgctgcacgtagcccatgagtgacacatgggcgcggactggtaatatgcagaactattctagagaggggggagcatacctaacagtgcccaccctggtccttggtaagtttgatggacccgggaaggagcccgaaatactccggagttgcgagactcccgcggccggcgtaatggcgaacatgggaaggtaaggcgcaccctaaatgcgcaagggacggaaaacctaattacaaaccacaactagggcagcagcccgactcgttgcgtgctacgaggataaactcgcattgcggtcagaggtggtcattgatacctgaccttaaacaatgtcggtttggcccgactggcccccgtagaggggctatcccactacaattttcaatt

SEQ ID NO: 2858 - DNA, 476 bp, Beihai tombus-like virus 16
  strain BHWZXX15284 hypothetical protein1
ggggctgttagataatattagggaatttccaatggccttattggataaactttttaatgcacttattaaatacaagctagaaagtctacttttctcaggatgaatgttcaatactcagcacgagctaaaactgcaccacaaattgacctccgtttctatgtagtggaacgtaatggggaaattctagaagccttcgcaagataccatcacctaccacagcagcaaattgcctattttcatctggcaacacaagaattaggatctactggtggtatcttgcctaatcaacgcttcgcctcatatcgttactccgttccaccaggcttccaattacatccagaattgaataagtggttcaatgccacacccgctattataaaacgtgaagtgctgaagaaacctaacgtcgtcatgacgccaatttgtgctatactagatgctgagctggtgagtccttaccttagataatcaaacgt

SEQ ID NO: 2859 - DNA, 484 bp, Hubei picorna-like virus 16
  strain SCM51353 hypothetical protein 12
aacatgatgtgatcttatattttagaataaattagtgatgtaaaatttgaaatatattgctatcatgttaacagagttacctatttaggtttacttccaagatgctctagaagcagcccttccaaaatctaggaaccatcactcgattatatagtttaagttgactatatagtttaaattataacttgctacaaatcaaaatacaattcaaaatacaacagatgacgatgctagtcgtgaaataagtcaagtacaaaacgtaacatttcttaatcaaggacaagaagttgaagataaagcactccctagcattgttgatattaacccttcatatttaaatgaaacattatacgatgtttctcatgatataccagattttttggaaagaccaataagagtgtggaatggattttttgataatacacaaacaccaaatacatcattggcaactttacgatttccagatgtattattacaaaacaga

SEQ ID NO: 2860 - DNA, 489 bp, Weivirus-like virus sp.
  isolate plw156pic2 genomic sequence.1
gtatatatcatcattatcatcatttcattatcattatcattatcatcatcacgtacgtactacattctaagttctgaccagcttagtcttatttgtcacatgagcaacattttagtgagtgtcggagcacaatcgagaataaagtatcgttatagcgcctcacgaagagtgtggatcacagttcaagtcaaaccgttattgttgtagggtatatgggtaacctcacactacaaacaaccgcggcattctatatttggatgaatatagtaattactagacctcaatgcttgaaacccgttgaactagtatagacaccaattcgttagtgatctagagttttgtaaattgacttaataatttaccgtcggagcccgcaagcccacctggaataattttctaattttcaagaaattagacgttcagccacgtacggctaccagatctaaaagagctcgtaatgcttaattacaccccaaacagattgaagaa

SEQ ID NO: 2861 - DNA, 493 bp, Shahe picorna-like virus 11
  strain SHWC13613 hypothetical protein 12
ggaagcaatgtccttactatgactttaaactagtaaaggtagtgacttacactcgtctcgtctagacgtaagtagccgagggtggtgaccaacaccacgtgattactgcggtataaggaatgtgacactttatgggaagaccaaaagtgtagagaaatcaaggattctatgtgatcttgcattcatgatatatggagtaaaatcatgattgtattgctatagaattgtcaaggtgctatttagtttcggtgtcctttggagcagtcctcctaaacaccaatcctccaaatttcaagcgttgtacagacgtcgtttgatcttaatattctggcctacaaatacaaacacaacacccgaagagagcgggaataatttctctcaaactaatgtagaagcatctgctacttctgaagtgcaagctactactatatttaatgatgatgccggtattaccaccagttctatcgacaatcctgcgtccatctatcaaaag

SEQ ID NO: 2862 - DNA, 495 bp, Laverivirus
  UC1 gp1 and gp2 genes, complete cds.1
gtacggcatcattcaccggagagagtgatctcacaacgaataagaaagacgttaagagcgttaacgacacggaaacggacgttttgcggttacctattcaggtcggcttccccgcgatagcagccctatcaaatggagcagtttccaacttcctaagcacttggtcgtgcgaacggattttacatcagaccagcacaaacatttgacaatataccagaaaacacccccaccccctatcttgctgataattcatcatcagtaacagacaacacaggtctatttggaaacacaacacatgagcaaactggaaccactggctttactgatcaatcagtcgaagtagtcgtcaatggcggagacttaacagcaggtctctttgaagatgtagttgcaacagatactactaataccatcgttgattatctatctagatatcgaaaagtttttgactatcacttcggttctaccattggttaccatcctattgcagatttc

SEQ ID NO: 2863 - DNA, 500 bp, Erigeron annuus picorna-like virus
  strain pt013-pic-1-NW genomic1
aagaacatattgattaagttctttatattattacgcggatgatggcttgcgtgagggcctaccattcaaacggataatatacatagatcacttttatatgttttgtttttgtctttacatgtattcctttcaagaatatatggtgatgaagtcctgtaatgccattataggttaagaggcaaggtgtcttaatactaggtgaaacatgcaggcaggtctatttaagaattgattgataacgagactattaatgctgtgagttatttcgtgcaaaccgatcggataaacatttggcgacaaatgcctttgggcagagctgattaatttgcaggttaacattaatacgtattgtgcgtcgagcttcttttatagatatcggttgctagtattgacgaaatctagagtttgttttatgggactgctctgcggctaaagtaatagtgagttcctgactttaggcgtttcaagatgaaatcgtcgtttaaattttaaatctcatt

SEQ ID NO: 2864 - DNA, 501 bp, PNG bee virus 7
  isolate PNGBV/7 non-structural polyprotein gene,1
tgagccccaactcatggaattcttgttatagatactaagtcaaaagatgtgacgttaatatcgtagtttactgtggtaaaacgctttaaatgtcgattggtattgacggtgaaatctttgtatataacgtgacgttaggtacagcatcatactccggtgaaacgttttatgtataagtcgatacactaacggtaaagttatattctatagttttctcttcaagttttaaaaatgggaatccccctttattttaattgcatttatattcgcgtaagatctcttcttacatgcgtcttattttgtgttcaacgacattatcaaccgcttatctgggatagcaacccgttaggatgtcgtcatggtgtactacctctagatagttaaaagctagcatgatccttaagcaggagatgattgtatctagagaaggataatagttcttctacggaagcaactattttattttattttatttttaagtcttatcttcaatgtgacctt

SEQ ID NO: 2865 - DNA, 502 bp, Sunshine virus
  complete genome.2
aaacggaaatgaatgactttgttaagatttgatgatcaagttcttcactaaaatatacactactcagaaagagtagattgtggactttgtattcaaagagttaaacccacgagtcatccttcaacagagtacgagagaactccacactcttcccaattaaaaaatagggagagggagagagattaggcatacctagatctagaagttcagattctcctatctttgagcgtgttgaacaactcccaaaaacctagtcattgaaggcttgagaagaaggcaaagaacacaaatcacttgtttttgaatacttactgtctctaagtatatggacaaagaccccctcatcacaaacattacctcttaattggatgattaaatgccaggttgagatactctaaaaatgaaagaattgaagttagggctgtagttatctatcaggatcacagggtggcttatttttcaaatatattgggttttaataagaaaattgaagggcattaaa

SEQ ID NO: 2866 - DNA, 506 bp, Hubei odonate virus 6
  strain QTM11719 hypothetical protein 1,1
ccctagggggtggaattaaaattccaccttctagagatttttacccttaataaatgggttaacgatgataaatatttgagtaacactctcgtcaatgctcctagagttaacgaagatccaagtattttattactctcgtcaatgcttatttaatattgtatttagttttaagtttttatgtgtcgtggtgacctaaaaaccaaccaatttttaattcataatatcattttaattatatgataacccgtttaggctgtatattttatatgcgtgttatataatatcatttcattaaatttcatatattcattttaatttttgttaggtcattttcatccctaacaaattcctttggttcattttgagtttatgattttattattttgattagatgttttcgatcccctctttttattttaaaaattaaattacaaataaaagataataagacttctaccagagagagcagttctaaccctgcgcaggtagttgatacgtgtgttagg

SEQ ID NO: 2867 - DNA, 513 bp, Victoria bee virus 2
  isolate VN2-6 polyprotein gene, complete cds.1
gctactcacaaccttgttttctttctttgattgaatcaagccactgtgtttctccccacacacaaccactgtgtcttcttcggttgatatagtgccgctgtgctcccatcccacccattgcccttcttgatgtcggttctgttatttataacagcatgtctctggtttttttctttcggtgatctctcgcactagcatagattgcgagaacgatgcccttgaatcggtttcttcggactaacgaattcacataagtcacatatctttaaatgtccctctagacatgttaattagagggaaggtatgtatcagagtgtgtctacggtaccctgtatgtcaatggttagatgtacaaattagggatacggttatggcccaggaaacgttggtttacctgggttatacataacacaaatgctcattttgagcttctcttcttatgaatttattcatgcggcgaatggaacgcgcgtcttcggaccgtaagtactaatagccaaccacacatttgaa

SEQ ID NO: 2868 - DNA, 513 bp, Sanxia picorna-like virus 5
  strain SXXX34146 hypothetical protein2
ttactctacaggagttgacgttttctgtagtgctttagtttggagtagtcgaatctttcgaccccgggttatgagtaaatcctggggtttaaaattttactcgaaactaaatttaataatgaaaaccgagggagtagtaaaccctttacaaattcaaatggtggtattccacaaggactggatggtccgaatcacaaaagagttaactttgctctagaggatacactacatgattatagtgtagcttctgaagaaagtagtgacattacctcacttaggcaacgccaatttctttttgaaattggcgattgtggtaatatttctcagttttgccgtgctcgtcgcgctgctcgttctcttgttcgcttgaagtatgaggctcaatctttgttagagtctattgctgattccaacgttcaagccaatatagttggatttaccgatcacgatgctgggtatgaagcgggtttaatatcagcccgtgatgacagttattatgttagtgatgaaccc

SEQ ID NO: 2869 - DNA, 517 bp, Hepacivirus sp.
  polyprotein gene, complete cds.1
cccactagaaacgatcttctagaatggggaaccgcgacaagtgaatcacgatggactaagcgaccaagagtttaagtgacagggttgttcgcgtaaatcccggcttaaattcaaagttgaatatgtccgtacggagcactctagcaccggacgaaggatcgtggacggtgggcgtagggtacacagggtcagctgtgtataaactcagtactgaagcaggatttgggagcattgcagtcacactcaagtggagtactccgcctttaatacccgtatggggcaatactccgaggagggcgggttttcaaacgaaacttgagtaatactttatatggtctcaatatacacttgtggatgtagggaaaccagccatgggcggacccaaggcggcgcacctgacacatgcggcaagagaaaaaatccttcgggtgatctctgggtccattccaaaactatgaattgcgatttgtgcttacctcgtgttggttggctttgaacactaaatacaaacactaca

SEQ ID NO: 2870 - DNA, 519 bp, Wenzhou picorna-like virus 34
  strain WZFSL80163 hypothetical2
ttcgtgtttaattgagtttccggtctccataagaaaccggcctacttcctagggattagggagccacgtgtggtacacgctatgcagtggtgcgcaataaaacaccgggtttgatctcctttataatgatccatttgtcgatatatgataatcgtcgcaagttaatatgttcaattgtttattgtttctaggctgtatacacttgtgtttttacttgtaatcccttggctatttagccttactaatcaaggtggggagggtaattccaatacctagattctagatagcctctgaccttgagttaaaatcggaggtgaattattgtgactcgctattactaatacttctcaagaaggtgtcccttgtgagacaccaacaaatacctcgggtccttctgctcccgaggtgccttctcaggcagttaagcagaattgtttgtcaaagctagaaggtgcatcgtccactgcctttcaggaagatggtgctgtagtatctggaacaactagatctgttccatca

SEQ ID NO: 2871 - DNA, 527 bp, Anthurium mosaic-associated virus
  strain PHA segment dsRNA3,2R
gactaagatccagtccaccttctagtgtgaccagtctcttattctattggttaatgtctcagcattgtctgccgatacattaaccatatgttactaatcttgtctctctctgttccatttactaagaaaacttgcttccattaccatccaaatctgctcacgttctcacatattcttgttgttatatccacactcgcactcggtacccgtgtacctccatgcttcatactctcgtcttcctctactgcacttctttgttctacatacttcggtatttcctcatccaccatctcattttccaaccggctctccctcctctctggttaatgaatagctcttctagaagcactctgacgtctcccatactggactcactctttaatttacccatcggcaccaactcatctgccactgcacttcttgttaacgcatcgcagtgtataccgtcataggttattcctattatcttatcatgttccactccttttgtaccaatcccatatgcttcatttattcttttatcatat

SEQ ID NO: 2872 - DNA, 527 bp, Salem virus
  complete genome.2
ttatttatattaaagatcatgttgctcctcagtcagtatatataatttagctgattgacccgaattactacaacccacctttaaagctactagtctttgctcggccaacttttctaattagaataaagtcgctttccttgcagctaataatcctaaggctacagccaattgcttgactcctggaggttacacatgggtaatcatttgagcttgttcagataattacaagctgagattgagacaaaataataagaggaatttacctgtcctaatttaggtttagaagtgctctaagacagttaatcaattaataaaaaacttaggaatcacgtcaaatgaggcacacactgctctagaaccacacccaagcaccccggtttcctcttacacacccagcctgcatccccacaaaaacccaaggctttagcaagcccaagccaagcaagacgaaacccaaaaatcacggttcgactcttacctcattctccaccggttgcaattcagcctcagcatagcctaagggaaat

SEQ ID NO: 2873 - DNA, 549 bp, Beihai picorna-like virus 72
  strain BHHK126587 hypothetical protein1
gcaaaaacctacgcacaatatggccttagtggtgtttggccttaatttatagcctttggttaatcgacgccctctttgaggagttaacggacggccagctatggtcaccagaaaaatagcactttagacaaatacatttaaaaattctatattttcttgaattaagattgaagttcttgaactgaaagtcttcaatgaattgtgcaatgtacgtgtaaacagttccccgcgagggtgtcccacgttcttagcgtttcgccattgcattttgaagttgttgcattagtatgtgatagaaccaatttctctatgacctggactgtttttaactagatggttatggcagtaatctagtagttttgtaccaggcattaactcaactttagtgatattgtctacttgatacgtcgcgttttaaaatttaaggacaataggcgaggcccgcgagttgtcaaatcttaagtctatacccagatggtaaatagtatcactctagatgaggctaactaaagacttcttaaaacttctgcctttctttttccaaaattt

SEQ ID NO: 2874 - DNA, 553 bp, Blattodean arli-related virus
  OKIAV101 cRNA sequence.1
tagtaattaagaaaaaccaagacgctcaggtctttcatctcttacaagaaaatagaatggcatctacaagctcatcaaaaacccataataccattgaatctgtaaatctggtatatgatttacgtgataataaaagtggattcaattatcgcggtatcataaaattggggagatctagaactgcggaattttcagaacaaacgagaaaaacaacaataaagaaatggataactaaaatgaagattgttcaagggaatcctgtagaacttttaatacaatggagcattcctacaaatcaagatcttgttgaattgtgcttctccacggagatcactagcactgatttgagtatcaatttgggagtccctcgatatgaaataaatattgctgatttggagatcataaagtatgaaattggactgagttcgactcctgctaccaaaactgaactgaactattagggattatttacacatagtatttggcttaattaattgattaagaaaaaccaagaccactcacgtcttattttcctccgtattcctatataaac

SEQ ID NO: 2875 - DNA, 555 bp, Beihai levi-like virus 28
  strain BHXG26591 hypothetical protein1
ccccctagccgggggcaagaacgcaagttcacctctagaatcacctgtacaggtgcgtatcagtgattggtacgttcttgtgcggctaggggtccaatacaactgctacttgcagtcggacacatttcagtgccggcatgtacgtggcatttcgcgacgcactcagcctaaaggaggattaacattgtgcgtatttcacacaaatataatcaacctacctggttagagtgtcggtccgataaaaacggcccgttaaggtacgaggaaattactgttgaaggtaattccagtactccagatcgacaaataccctataaggctgcaaagccgtatacaagggcagatgtctttctagatagcagtgtaccatctggcgtcccggctggagttagtcttttagacttgcctacagccgacgacgttgttgcatcgttgttatctgacgagcccacgttggcatcatctgtgtttcaaccctttgttgatacgtcggatatccagaatcaggcacttcaaaatgccattgagtatggaaatatcttactccttgtctct

SEQ ID NO: 2876 - DNA, 562 bp, Hubei tombus-like virus 2
  strain WHSFII19265 hypothetical protein1
tctaggccgatgacggaatttcgctccttcgggggcatgcacggggaacgtaccttcggggcgtgctggtaatactcccaacaattctagatgcgtactgcgctcagcgccgggcacaccgttaagtgcttcaccctggtccttggtaaggttgatggaccctgaagaaacagtaaatcaccgggagagtgaactctcgttacatcatggttcgcccagttgcaaacgcgtctagagacaactaggcagagcggcagagggaagtgagacactctctgaagcgattaaatccgcgtgctgtccgtgactatagctgccgccagcggggattggcgatcgttaagagaataaacccgcccacgcatttgggaccacattagtggtatagcaacaacaaccagtacggaatctggtcacgtaactttccggccagcccattggtttaccactaccacttcggtgttcttgtggcattgggacgtacgctaccgcgagggggccccgctctgggtgatgagacggttgatggtcccgtagaccacacttccccccctacgacatc

SEQ ID NO: 2877 - DNA, 566 bp, Sigmodontinae hepacivirus
  strain On/2012 polyprotein gene, complete1
gggggcccggcggaggaccaacgattgacgttcttcctggtgacgggaagtctctcgttggcagctccgaaaccgagcgctgcgttaacccgagttctagaatgctacgcgatcagctattcatggacgaagactcgagcggcactagggtaagggttcttcgggtaaatccctcctaatgcttaacgtttaataagttgttgaatactggtttgctacgcggacgaagctcggcagctccggcgccacggtcactggttgtgggttatccgggaacaaaccctccggttgggtaccgtaatataggaaccccataacccgggcctcccgaaaggagctcccggggtaccctaaccctgcaacgggcaaggacatcccactacgccgcccttcaaaggagttactcttccaatatattcttaggcgggttgtcaaagtgggccgcggccgtgcaggtcatcgggcttggggtagccatggggccaccaaggcggggagtccccctactcccctagaccaaaaatcctacgggtgaggtctggtggcactttttccttatattaacc

SEQ ID NO: 2878 - DNA, 572 bp, Hubei myriapoda virus 8
  strain WGML66308 putative glycoprotein,2
gtccttcgcttggtaattcaatgttaattgtcctttctgtcctcatgttacatgtgattttcactatctttccttaatttatcaatcgataattcaaaaaattggcagaccgtgttacttgccttattctagaatattttatttgtatataaaagtctgataatgttagtcttgtaattctttttatatattttaattactattcacattccgattttgactaagctgtcacaaagttaattaattaagacaacacaaatgaaattttttctatgtatattatatattcgtgttttaatgtttcaacatgtacaatttacaatgcatttttacaaacatacattaatcaactatttttcgaagagcttatcggtaagctctcaatattgaagtgcagttttacactcatgtacttaatggataccatttttaacaactatttttggcacattctcgtatgacactctatttagtattataaactttattaataaacaccctcggtctcataccaacctgttttaaaagcggttaattactgagtaattttagatttaacagctttgttcaca

SEQ ID NO: 2879 - DNA, 573 bp, Beihai blue swimmer crab virus 2
  strain YYSZX17850 RNA-dependent1
caacaatgggagaattacacgtcaatttccgcacacagctccaagttgtcaaagtcaaaagctcagaaccaggcgcaggctattccaaaacaaagcgcaggctattccagctttgatgaaaatggatctgatgaaggggaaggaagacaatgtgaagatgctgtagatggtttcgaagactcaatagttaagaggatcaagaagagtgttgacaatcaatataaggttggaaaggaagagtttctgaatctaggggaaagaaaagaaacacttcaaaaggaacctaagactgaatgtgaacatctcaaatttgagaataaagtgatcaaaaagattataaaagaaataacttatactaagactaagcgtgtggatatcacatactcggatgaagcaactactagtgaactggaagaatatctcaagattcacgccaatgaattgaatgaagctggaaaccaatggtataatattaatccaacatctaatttatctaaatccttacctgagaaagtgaggaagctttatgatgaactgaactttgaacttctagagaagctggattcaaatgaa

SEQ ID NO: 2880 - DNA, 577 bp, Bald eagle hepacivirus
  isolate NA03-001, complete genome.1
aacaggggcgagagttcctgttggtgtgtggtggccccacggaccatgcgaagtcgaatcctacgcattctagaatggatgattcccgtaactatccacggaatggcctaccctttggtcaagtctgacagcttcgcggggcttgagacttaggggtggagattccgagaggcctgtacgggtattccggacgaagtgcgataggtaacacggcgcatgtagaccgcgtggagcggcagaacagctcccgtgacaaggtcggttgtcacgttaataaactcagtaacttgttattagctactaggcttgctgtctacggaagatgttgagggaacgtcgcgtctaaagataacaataggctacggcccgcgagttgtcaatcctccctgggaacaggctcatcatctctccaaaaccagttttggctagtatgtgatgtaacatgttaggagaaatccaaccatgggcggacccaaggtggcggccccgacacagccggcaagaggaataaccttcgggtgacctctgggtccatttctcaaagctagagtgggtgtgtgtgtcgtcgtttgcaaag

SEQ ID NO: 2881 - DNA, 578 bp, Bipolaris oryzae hypovirus 1
  isolate ES35, complete genome.1
gtcttaggggtccctacttaagatcacccattgggtgtttaaaagggatgtgatcaggtttcatgaccaatcataacgtaaccttttggggtctacaatgattccttttggtggagatcgtaatctccgtgagcatagctcgtgtgtttcgtttaaaacacgtgacttgatagtcgtggttagctaccgtgcacctaggtgcgtgccttgctcaggcgtgacctaacggtctaccctatggggcctcaacagtggtgtctgaagacaaactgtcggtattgtgggtggacttgcgttccacgcgtggtattgcttcggctcttattctggctactgtattcgggttttgaagcgtaagctcgttcatgggattgggcccccatgtctggttgatggtcacacatacgtgtgtcggtactggtatctaatttcctttgttatctagaacctggtttgacagcaaacactctaagctttatttgtttctcttcctagaaacatcagccacgctcttgtcagaacggtgtccttttccaagcggggagtagtgacctttagcttgatccgttaaggatgac

SEQ ID NO: 2882 - DNA, 578 bp, Duck hepacivirus
  strain HCL-1 polyprotein gene, complete cds.1
gagcccatccccgaaagggggtgggtcagccttatggctgtgtggtgtccccacaaaccgactcctaaacctcgctggttctagaatggtttgatgtgttggttgaccactggtcgaagctaactagcatatggtgttagggttcttcgggtaaatcccagccacatgcgaaattagaataagaccggtgtgcaccaatgcctctcttccggacgaagccggtcaggcatggagcacggtatgccgagaggcccgccgcatcagttatcgcggtggcgacagggcacgctgtcgttaaactcagtcctgatacagttgctgctgtgggcattgtctacgacactggtttgcggtggaacgccgcgcttttaaatacacagtagggtctgtcccgcgggttgtcaatccgtaacccagaaggggccgtaacctagtgtcaaaaccaatagccggcaacagcgttctgtggaaggagcgtaagcaaccatgggggtaccaaggtggcgtcccgtgcacaggcggcaaggggaaaatccgtatggtgacccctggtaccatttttttcttagtagaatgtt

SEQ ID NO: 2883 - DNA, 582 bp, Wuhan sharpbelly picornavirus 3
  strain DSYC47507 polyprotein gene,1
ccgtggggtttaccccacgggatgttttcgacgcagctactgcgagagtgtagcctagtttacacagctagaaatctgtgtgcccttttgtgctcattttgggtgaataaatgatcacgatgcccatatcgttaaatgtgtgctgagggaaactttcgcactgtggcactcttttcggacggatctaggttatgactattgcttgaataaggaaatccccgttctagcggtgtagtgattggcactaaaccttgtgtggagcagtctagaccaacacataatagcatagtgaagttaatggtacgagttatggagtagtcgccttctatatattaggttggccctggtaacaggtctaatatgtaatgggttaatgccatatgtttgacgaatgccatgatgagttaaaggaagataactatgtgaaaggtgtgttggatgtatccctctaaggagcgtggcttacttaagagctaaccctgttttgaatagtacaccagcaaagaagcaagacgtacttatttgaggcagacttttaccaagtttcatattgtgagtagttggaaggttccagaaagcaat

SEQ ID NO: 2884 - DNA, 596 bp, Lassa mammarenavirus
  isolate LASV/H.sapiens-wt/NGA/2018/IRR_077 Z1R
aatgcaagatcatctcaaagtaccttgcagataatgagaagctatcaaggcagaagttagcttttggtccagaccgaacccagaatgttgctcatggagggactgaaactactatccctttgcattgagattgactctgcaaggccaatggatgtgagcataacactgaagacaaaacggttgaatccattctaagtgatcatgggattctcactccagctttatgctttgtggtcctgacggctacaaactcactggtaatgttctaatcttgcttgagtgctttgttagatcatctcccgccaattttgaacagaagtatttagaagatcacaagaaactagaacaattaagatgacttggagtctagacgcaggacaacattttacaatgaacagatacctgattgggtgaatgacaaactcagggacacttattcactttgttaaatactcacaagaagtaatgcactataagatagatatagaggattttaaagctaggaacaaattaaggcaagggaacatagaaagtcaatttgttaagactgataagatgagattattagaggattttgaaagctaggaacaataagg

SEQ ID NO: 2885 - DNA, 604 bp, Shayang Fly Virus 1
  strain SYY3-1 glycoprotein (G), putative1
attgatgaacagaaacctctaattggtaatttttttcttaaatcgctgtgtctcgcagtggtttaaaactgactaatcgggcattatcccctaaactgacctaattataccgatttctgacttgattcaatataatctcgaagcatgaacaacatgttaccctcaacgtctcgacgaaccggacagccggtggctgttaatcagttgaggcaaaccgccgtaatggctactaaccctgacattaagggtgcaaatgatacagcacgacaactagagtgtatcaatatgcgtctaactaaaattgagaagactctagaatctatccaaaataccatggagattttgagggcagctgcaggttcacctgcaccaatatatccctctgctccctcattagtcactgaggtacgaggactaccggggttagcaactccggtttattccagcatggacgctagacggtttgtataaagccaaataaacgggctcgtcccataaaaccgttaacagctactcaaaaccttttcaagtgttttaaaatcccttgtttcaggctctctatactcgtgatttcctcgtacaaattcctcgaatctatcaatct

SEQ ID NO: 2886 - DNA, 613 bp, Picornavirales sp.
  isolate tom099shi2 genomic sequence.1
aatcttcagtgctgtaaagtcaatctaaaatggcagccgcaacagcagtagcagcattaggtaatacagcctcatcatcttcaacagcaggtttacaaattttaggaaattatttaggtaatgctcaaaatttagctaatcaacaaactttaatgagccatgttgagaatacttttaaagagtctggtcttcctcgttatatggcctacactggcactggtgatatgccacagaacaggtatcaggtcagcggtggtaatttctactctgctggtccagttaattctaatttgcctacatttacaactcaggcacaacaagatacacattcaggcagaccaggaagaccgtatgaagcagttccaccttttaatcaattaggtcccaacaatgaaatgcgagttttaggccaaaatgatcgtcaaggtttaggtttcggtcgatataatattcaaaataattttgtagctgggggagtaatgacagcagccacccccaggaatgcagccgctcatcaagcagctgctaggattcttcagtaaaaactttcatccttaaaaacttcggagacccggttagataattgttatatttgtttaagtctagaattaca

SEQ ID NO: 2887 - DNA, 616 bp, Wuhan spider virus 3
  strain spider133889 hypothetical protein gene,1
aggggccccttcccctacctctcttttcggccagcggcctgctggtcctatgtgtgctacggacttattttcggataccagatacaagttatctccggacttattttcggaatcaccatagataggcaaccaaaaaaccttcgtgtcgtcattatgtgttaatgttacaagcaagtgtttctcccccttgcttggcgaagaaagtctaataacttccttaacaaagaaccctgagtgaagagccggtgtcaaaaccggaattggcggaaattggcttatgtcgaaactgatcagtatttgttaagaaatagtgttagcaaggctatagtattattgcgcaaacgagaattctaaatgagagtttattctgcccaaactgtgttgggagttcacatcgagaggtgtgcccttcgcgagatctgaagcagatattctcactaatcatggatgattcttgtaagcgtggtgtgctataatatcgatttactcaggttagatgaaatctgagcgtttgttataatagtcttctagagaccttgcgacgaaagtaaaggtaagctgaagtgacttccgagccgtgtgaagagaaaacggtcgtttttcccagtacttgatt

SEQ ID NO: 2888 - DNA, 628 bp, Beihai picorna-like virus 64
  strain BHJP54755 hypothetical protein1
tccaggggtgatccccctggactactttgaagtattgtgaaatttttcgagaaggattgtacacatgtgaccgtgaagcgcggtctgtttaacgagcgtccttttcgaaggacgcggattgcatcgttacacgctattgagtaccgacttgatgtgcaatgaatctgttctattaagcttatttcaaacttttgctgttttacagatatttaattattctattaacctcgaccttcatatgtaaaggtggaggcgttggttttgaatatttaatattctgtattgttgaggttatcactatacattattggaagtgaaaatttcctcaatcgaggagagtttggcgttttcaattaaaaacgcattttctagataagtgtcaagaggctctaacgaacttgatattgatacttattttgcactatacacttgtattgttctgaatgccatataggcccaacggaacaaattggtgtctggatgaatttccagctagaccactctagatctgtgattttgtgctttttaggaaaagtaatatctaaagtttttcatggtttttcccagagataggggagctgtgtgaagtttccacagttcactttaaataaaccttgttttctcaaga

SEQ ID NO: 2889 - DNA, 631 bp, Cryphonectria nitschkei chrysovirus 1
  Cys-Pro gene for cysteine1
tgataaaaaacaaaaaacctcttcagccagtatctgatcacattttgggcaaccaccgtcgtgttaaatgttgttggaaatatatctggttgattgtggtggcgaggcagatgtgtggtctgggggtacagcctcaggcagtgtcatctgcgatcgtaaatgtctgtttcgcgtgacggcagaacaggctaaaatcgtaatcggtaggcagttactggtggtaatatccgatgataattcttgtgaagtattattctgcccgctgtgtggattgggcgtctacactaacactaggaacatgcatactagcgaagtttacgttgagcacagcgaacttccagtgcctagacagtggtcgcacctgatgtcggcacataagacatgttctaacgcatatgacttgctgttatcgcgtggaaagttgaggacacggcgtaaggcagtcaccggtactcaggtaggtacagtattgtatcgccgagggtcggtatatctagacaacattgggccaattggcgttgaccattagctgaggggcctgatgagtacctctcaggaggacgaaacgccaatgcgtcgccccggggcaagataacagtaccaaaagttaacgtaaggaatcaacaacaca

SEQ ID NO: 2890 - DNA, 633 bp, Marburg marburgvirus
  isolate Marburg2
ttcttattgttcaaagttgcaagggaagttatcttcccgagttgatacaaagacactaaacatttcaaaagcatgtatgtgggcaaaacgtaactagaccatcttgattgaagtagtaatttatttctgtcttaaatgtgattttcacttcaaaagagttaaatggtgatagatcaatctttgaaattacccatttatacattatagagaaactaatattactaacaaaaggggtctacctaacgggtatgatcgagtgatcagtctatcttataaaccaaacaattgacttcttactttttaagaatcaactaacagcatagaaaccacatttatccttacgtaatctttggcttagttggaattaacttttgttgtaattcaatacgtttagtcatagtatattgtaggattttttataagtttagaataccttaaatcatacccacaaaaaatactgttttaattaagaaaaactatgaagaacattaagaagatctttctctcgtagtgttcttttactggaagaagtattccaatcttaacttgttggatcagttgtcacttaagttgttatttttaaaattgattcacacaaagtagtttaaatttgtatctagaataaattttaat

SEQ ID NO: 2891 - DNA, 635 bp, Chinese broad-headed pond turtle picornavirus 1
  strain WHWGC1513141
tctcggggcagtcggtcggggcggttagtgccatgtgtagggcgtttaaagacgcaatactattggtgcggccgttactgacttcctgtctcgcaggtcccactcccctttcccttttcatgtcgctatcttctctcccccaacttttaaactggactgattttaacgtgtaacagatgatttgtggattatggatgtctagagatatgatctccgaaacctagcttgtttcgctgttattgacgcatttgtcattcgatggtggctaagtgcccacaaccctaaacttgggtgtggtcaacacatgagtcaattcgtctgcctaattcgccatgaggacagtaacgtaattgctagttagtagaaatcgcattcttgtgtcataggaaacctgtggccgatagttggtaaccactccagcgtttaggactcagagaattttatctttctatgatttaacacaaggactagtgaggagagagtagaggctgtagaccggtttgggacctcattgagtatcccttgcctagtagcaccggctatggactccgggttggaatcccggacttggctctatacttcctgatagggacgcggctggccgcttctcactagtatagtcagttgactttcac

SEQ ID NO: 2892 - DNA, 648 bp, Solenopsis invicta virus 5
  isolate formosa, complete genome.1
ttaaaattgtacgtagggaacaaccctacgtacaatggcctgagccaatcagaccctggttttacaccagacaataattggcaaacaaaaacattgggcgctatagcttaacggtgcgtcctgcccccgtatggagtggttgaatataagtgctataccctgaggagggaataatacctaagtctatgagaaacacattatttatcgacgaaaccatttaagctaaatgattatgatttttctataacgacaaacagcgtaaactgtataaacttacaacaacccaacggattacgaaccttaaagtaactgttctagatgaagtctagtagtctccaaatattcccgtgaaacggatgatggacggaacagctctattttaagacgtgaggctttaaatattgataattacattacctgagagccctctttatgaggtttgattattaataaaattagtaccaattcttgatagaatttaagtatgttaacaatgctgaagacatgtatttcgattgttaacctctacatttctatgaaaaggatatgcgagtctcggtggatatcgcattatggtcgcagtcaacctgcagttttattaatcccgtgtcggagcggtggtaatggagccggactactttgccaaaa

SEQ ID NO: 2893 - DNA, 650 bp, Riboviria sp.
  isolate wwb174shi05 genomic sequence.1
cttgttcttacactctagaacaaacatttctggattctccaaatagaacttcttgaaaacttcgggccctccctttatggcatcaaccagggcgggcactccgtattccaacacatcgggcaggcattcccctttggacctccaatagggtgctcctgctgaggcatttttacttgttgtaacatctgccagcaattccgacaggtcttcagcgtgccagcttttaacctcacccaccggcaacagcttctttagagtggctactttcgcgggtaccactcctgtcgggtccacttttatatcgacgcacttacggcttgtcatcaaactaagcctattaacaaatccatcaacggttccactcgagtatatggtgctgttcattgactcggcgacctcctccggagagtacacccgaacaagcccactcactgttgccggtgggtgaggttaaaagctggcacgctgaagacctgtcggaattgctggcagatgttacaacaagtaaaaatgcctcagcaggagcaccctattggaggtccaaaggggaatgcctgcccgatgtgttggaatacggagtgcccgccctggttgatgccataaagggagggcccgaagttttcaagaagttctatttggagaatccagaa

SEQ ID NO: 2894 - DNA, 651 bp, Umea virus
  isolate OTU2.IU18 RNA-dependent RNA polymerase,1
tgaggtcctgatcgcctacccctagcccccttgagcagaatctcataatcccttgtgtaatccccgtctgatgcctcctcctcttgaggcagctgttttaaaacctctaccatgggaatgagatacaatgtttagcactaaacctagacgatcaggacacgatgatgacgatgacgacgaggtgccttatgtgcacacccctagtacttcaggtgtcgtcactaggagggtaatgtccttggacgaggtgattcttgccaagctgaataagctcgaggcagcagtggccaagataagccagacccaggatgtcatggcggcagagatgaccaaaatctcgacggtgctggctactgttcaagcaatcggaggacgcgagagtgcatttagaatcagcaagatgtctgatggccctcaggactctaaacggaacagaccgtagctcgtctagaagacctgtggttccacaaaaaccaccataaacaatattaacaaaatgctgttttaagtagatgatcggtccgatctcgtgcaccctgttaagggttagctgtgtctgttttaaaactccttttcttctgaagagaaaatggaaaatataactactatcctttttatcataggagcacgattgctggacaaagcgataaa

SEQ ID NO: 2895 - DNA, 652 bp, Linepithema humile virus 1
  putative capsid and putative RdRp genes,2R
gtgcagtttttatactgcacgcacaatgacccgctaatatatcggattctagtatttctagacaattatatattagacctaatttgttttgttaatattactttcatggtctttaaatgaggcgaaaagtaaatttaaccatcctaattgtttgttagtatatttcatggatgtaaaatgaggcgaatcaaactaacaactattttaatcaattccgaatactatgacgaaaccatttgaatactattcttgacctgattatgatataacgacaaacagcaattattataaactgtataaacttttaataacaacaatggactacgaacctatatgtaaccaagatatcgatgagcaatctcgatcccaatataagagtgaaatctttgagggccgttttggcaatgtatatagacgtggggttttaatggctagtaaccacattacttgtgatgaaactcaataactagtactaattcttaaataatttaatcatgatataaatgctgaagacaagtatttcgatttatatcctctgaatttattaaagaatatataattactcggtggtaattatattttagtcgcagttaacctgcagttatagagcatcctgtgtcggagcagtagtaatgcaacctatcaacgaaac

SEQ ID NO: 2896 - DNA, 653 bp, Changjiang picorna-like virus 6
  strain CJLX30470 hypothetical1
gatatacacttattagtgtatactttatttgcctgaaccgatgtgagcagtatctcccggagtgcggtaaccatttagcggtcccagacacagctgtctctgtgtaaaacgggtaatttcgggtagggtttattcatccggtcattttattccgtccattatggacttcatccatcattgacattttatttttgtggttggagagctgttagaagaagctctcgtttgcaaggtaggctttattttaagctgaggttgacagatcatatctatacgacactttggtgttaagtgtttagtcctcaggtctagctatgcgattcgtagtctagaccttaatggcagtgaatcgtacagtagctggtggcaatatacgtaagaccaccatactggcattccagcagtggaatgtgacgcatccttagatagttgatgctttcatcctatcttccgctatggggcatacccattcatgattcacaggtttcccgttatagtgcattttgaaaacgtttctattgaacacgactgacaagcatgttgggggaatcctaataggccccaacggaacactcgcagagccgttaacaattcattagagtaaatcgttagtagagtgtaccggtagggcactgtcattgaaaatatttcgc

SEQ ID NO: 2897 - DNA, 656 bp, Ranunculus white mottle virus
  isolate E_Meta-contig815 polyprotein1
ataaaacaagcctataatacaaatctcctgaaaacatacaaacttttgagataaaatttcaaatacaaaatagtcaaaacatgaatagtgctgattctagaattattccgatgaataaacacaaggaatttgagaaggataagctaagcttgcaaaaaatagtgattaatcctcaattgcaagaaagaaacaatcatttccttgatatattatcacgatacaaaactagttattgctcaaaagaacgttttttgtttggatcatggttaattaacaataacttagtcacttctccttttagtcctaaagcgtttataataattaaaacgtcaaatgagctaattgattatgatttgtttgaaggattggaaatctatttgatcacttctcttgaatttgcaataagttcgtatgctttacatctgttcaaagaagattttattatgcaagaaaaaagaggagaaacctcattgatcctcaattcttataaaattcctaagtactccctaaaacttgagaaatcacaagagaatatcctcaagaaaatcaaagaagactatagttatatcattaaaatgaataaatttaaatgaggagttaaaacaaatcaaccaataaatttgcatgaaaaatacaaaagaatcttgcggcttgat

SEQ ID NO: 2898 - DNA, 664 bp, Hubei picorna-like virus 47
  strain WHYY21982 hypothetical protein1
cccccttttcaacggcgctggcaaattcgccgtattgactattatgccatcctatatcagtcatccgtggcctttatatcgattcatattagtcaaatatttgccaaaactttactttcagtttagtttttcagtgtattttctttttgtgtatgtacgttgtattttctatgtaagcgtttgtcgcgagtgttgaaaattctctacaattacaatgtgtgaaaatttgaattatgctttataactctaccctgtattgtttatctaagtagtttcggttgaatctaaattggtgaatttcgtagatcatgaccaagcattttctctgaccctatgtatgttaaatttacgcaggttaaaagttattttagtgtttttcgagtgagtatcagttgtgttgatgaggcttcaaattttcggttttgacttgacacgtgaaaacccattatttgattctaagtgcttaactgaattctaggctctgtacgattgcttgttaaatccatgctgtcaacatgtgctacgcggctgtagcggtacaatttcctagtgtaaagaatggctggttagaacagtccccctcctaaagggaacctccctggtcgccggagtatgtaaatgcgacaaatgtctagacgacaagtttctttttctacgtatcact

SEQ ID NO: 2899 - DNA, 669 bp, Oryctes rhinoceros picorna-like virus 1
  complete genome.1
agagacccccttttcaagttttgtgtgtgattacattgcactttggattacaaaagttttccaagtttgatcacatgaaactgacaaaactcgacttttcgttttgttttgtcttgtattttgtttgcatgtgtaatgcaaatatgtagtactgttatgtacttatatatcgaagctataggtatttaccgaaacctattccatctgatggctatggttgtggttaagtctcataaacttaatcaccattaggtgagcgtctgttgacttaaggaatgatacagcgtttaatctcctagtgtcgctttgatgttgtgtgacatttcaagttctcatacttgtgttatgtattgcggtttggtagttgtcacgtacacaactactgggtttgtttttgcgttcagatgtctagacggttagtttgtcttgttgtatagacccgctttctcactttagtgactttgcgttagtggacattgcgcatcgtgttccctcaaaagcacaaatgaatttcatcgtttcggcagtgtgctgcaaatgttagaccaagttgtcacattgcagtttccggatatttatatccaccgagcgcggacgtgaaaaataatccgacacattatctcttacgcgtataaggggatgctaggattcatttaaatcttacttatc

SEQ ID NO: 2900 - DNA, 670 bp, Soft-shelled turtle systemic septicemia spherical virus
  strain NBEC1
aggtggggggggcgcttatgcgtcccccccttcttttcccttcctgtccgatgtcggtctgtctcctgcggtgcgtcgctctatttagagtggtaatccgtgggttcagtactggttgaggatgggttgggtcccattccccctccctttaacgtcgctatcaacttctttgtaaccccacactttacatggactgatttaatggcttttgatgtttttgaggattatggatgtctagagacatgatctccgaaacctaacctgctttgctattattaacaaatttgttatatggtggtggctaaacgcccatgctcctaaacttggagatggtcaccgtatgagccaagctgtctacctaatttgttatgaggatagtagcgtaagtgttagttagtagaaatcgcattcttatgtcatagggaacctgtggccgatagctggtaaccaacccggtgtgtaggacatggagcaagtcaacactctatggtaaacataaggactgatgcgagaagagcagaagctgtagactcgtttgggacccaatttggtatcccttgcctagtagcgcgagctatggactccgggctggactcccggacttggttctgtacttcctgatagggacgcggatggccgtctcgcattagtatagtcatttgcaactcac

SEQ ID NO: 2901 - DNA, 678 bp, Cragig virus 9
  complete genome.1
cgcgtgcacgttcacacgtgcacgcggatatgtagatttagatctatagcaatactatagttgatactttttgatggatgatatccaatttatgagagtttcgactactcatttttggattatcacatccatacttaaagattgattgttattgagatacatttacttcttcagtacttattaggtttgaatagccttaaataaactacttttctaagaaatagacacttaatgcttatagttgtaagctgcaaatactgtcttgaacagtacaactaccccccttttttctattaatcatcatttttctcgtagaaaatgaagatttgattgtcataattgacatctcagatgcatggcttgccctgtctgttataccggataatatccgttgacgtcttttgtgttttgatgtaaatataacgaaaacaccacacatacacacccgtctcgaaatcactttgtgttactagaggcggggaaccgtagagtctagagttatgtcattttgaaggagcttgctcctagatggtaactatacattttcttagattttgagtttcgccacttattatccttgatagagaactaaaactagtctcgtttgttgaacaattttcttttgactttgtcagaagtttatttgttcactcggttcatgtattttaatttaataac

SEQ ID NO: 2902 - DNA, 681 bp, Rhizoctonia solani ourmia-like virus 4
  putative RNA-dependent RNA1
caaaccgattttagtcggtctgtgtcgtgctcatcaaactggaaactgagaaattagaatctggtagcgtgaggtgaatggatagctcgtccgttcattgcgaggccccccctgagatgacgaagggagagggtactgtgcacgggtaaaagaagaaaacactctatgatccgagttgagtgaaatcctgttgtgacagacgccggttgaggcagtcgcgcagagaggaagcgattcctggatatagaggtatcggcaatactgatcagaggcgtgaagacgcaacatcagatcaaacccaacaaaccggcacaggcgttatgaccctgtgttacgacagaggccctactgtccgggacctgagggaagcgcgttcggctgagcgctgccggctttatgcccgcagaggagtcgtcagaggttgctgtggagtgaccgccgtgcggggtggtggcaatgagtgccgccgccgtcagcgaggggaggagtgagcccaacccccataccaaatcgcgaacccggtgcgtattaacgcggaagacgccggggcctgtagatccagaaacgcggggaaccaaatcccgcacaagaggacgcaggaaaaattctgcctcgttttggctagagcagattgaagtctagactgacactgacccgggcttggaattgccggaccagtgg

SEQ ID NO: 2903 - DNA, 683 bp, Hubei picorna-like virus 17
  strain horsefly124179 hypothetical1
atgggccttaacccatgcaccttctttcgcggaatctatccgcgtcgctttaatgcgagcaatatagacgtgaatatatacgataattatatacatatatagttttagtttggtgtccatttgacattattatctttttatatatgattttgaacaatacatgattcaagcattatcttgccagagttgcgaagatttagttctgtaggactttgtagtgacttaagcacctaatagttgtggtagaagattgtagtagtttgtttcgaagctagatgaaattgtaggctgagttcagagtgagctagaggactgccatcctcgttgtagctattctaactgtactgtttctagttaactagtgatgagaacaaattagtactatgcttttatgtattctgatgaacggtggttttgtgaattatctgttgtgtgttgtgatattgattgtgtaaattgtgcgttttgtcgatgaagatgagggttttggtgtaagcagcaaaacttagtttgatacctcattgtagactgcaagcgttcgaaatcgtgaatggtcgatcggttttctttttatgactgttttatagagtttctagagtgattacaagtttatttgctggcaggcaatttttgatttaaaaggtaaaatattgagagttatttgttaaataataaattacaca

SEQ ID NO: 2904 - DNA, 695 bp, Unknown
  Description of Unknown: UNVERIFIED: Potato virus Sisolate 18-1113-2, complete genome.1 sequence
cagcttaggtaatcagcttagtagtattgaataaatggatgtgtttttgcaagttttgaataaatacaagtttgagcgtgttagtagtgctttgaataaaccaatagttgtacatagcgttccaggtgctggtaaaagttccgcaatcagggaactactgaagttagatagtaggtttgagtgcatcacccgcggccggccagatattcccaatctagagggtgctttcatcaagagcgaacgtagtggtgaggataagctgttgctggttgacgagtacatagaggggcccgttccagaagacgcttttgcaatctttgcagatccgctgcagagcacagctgttagcccatatagagcgcatttcatcaaaacactaagccatcgctttggcaagtgtactgcttcgctcttaagggatttgggttgggacgtgcaagctgagggtcaggattcagtacaaattgccgatatcttcacggttgaccctaaagaaacagttgtttactttgagccggaagtcggggagttgttgaggaaccacggcgttgaggcgaattgcattggtgaggtgcgaggagctacttttgagcacgtgacgttcgtcacttctgaaaacagcccactagttgataaggccgccgccttccagtgcttaacgaggcacaccaagagcttgctcatactgtgcccag

SEQ ID NO: 2905 - DNA, 697 bp, Hubei picorna-like virus 5
  strain WHBL70549 hypothetical protein 11
cgtatatgagctgatcactcatatacgcacttacgtttctaggggatgctatttagcattcctaggatggtatccagaccaatccgagttctataacacatttggacctaactaaaaggcctaaatggtactagggagacatggaattatgtgtgaacgcacaaagacagagctacacgggctgcgtcttttggcgtatgcagcgagtttataacgtgtctttgatgcaatctggattagggaggggacatttatgtcaccctccagtcaacgatcacaaagagttattttgcttccgaactctataaataaaggaatataccagacccgaggctaccgcctcacctttattgtctattggcaatatttaccctactgttggtgaataaccaaccttattgtatttttatatacagtatgacacccactcaatcattataatcgaattgatgaaaaattggacaagcatgctgtgatgatgttttatgaaatattagtaaatgttttagcttttctactttaggaattgaagacgataagactaggcgcacttctctagaatctagatgggcaaaccccaaaactagactgatgtgattgcgttggttgccgagtccgcggagaatatccgttgctcctttagcgaaatctattatgttgaaattatgaattgattcattattggtacgaaatctca

SEQ ID NO: 2906 - DNA, 698 bp, Beihai picorna-like virus 61
  strain BHBei76813 hypothetical protein1
tggggagaccccccagtcaacattggtagtttctatcaatgccttcgccaggatttcttaactatgataaggtttaatcaccggttcatgcattatatgatagtgcaaaatttttgagtaagatcaacatcggtctcatagatttttctctatcagttaatgttacagttacgtgaattgaagattgcgggtggcgcccgcttttgggagcatctatgctcccgcccctttttgagttttagtgttcacttttgtggacgtcactcaattatgtctctctatctagagatagctctagatataatcatttgtcagagagaggaagaacaaatgctaagtgtatagttacctgtagctccgccaagcctacctggataccttagaaatcgcggttttaaccgcattattggtctggcaaaccttctttgtttgttaaccggaggcaccaaggttaatgaacgttaaagtttttacgtgtcgcaaaccccctttatcgaagcgtaggcttcaacctttttgatgatactcctgatgagagtggattgtttgatgttgaagaaacagaatttgatcgttgcgatgatgatcgcattgatgttgccgaattgcaggcattttttgatgaggaggatatcggtcgaagagccgatgagaaaactgttgaagagacagttgaggtgaagcggcgtaaaggcaag

SEQ ID NO: 2907 - DNA, 699 bp, Human parainfluenza virus 4b
  strain HPIV4b/Seattle/USA/SC0496/2019,4
ttgcaaccaagaggcacattttgcaaatcttacctagatgcatctagacaaatcgcccacaaagaaaaacaaattcccaattcaccaaaagaaatccaaaatcaacggagctacagctatcctgaaacaacactgcgaccacaatgacattcctcaagaaataaaggacaaatccaggaacagaaaaaaacagcccagaacaaactaacagacagagaaagggagaggcaaacccgtctcagcaaaatctcccatcaacatcactcgaccaagaccgaaccaacagcacaaacgcagaaacccactaccgcaaaactacagaaattctcccacaatcccccaccaacattcaccaacaaaccagaaaatcattcaaccaggcaacctccacatttcaagtttaagaaaaaaactattataggggggaacgcacttctcagctctaaccacacgaggccttgtcttgtaaaacaagatcaatctcacacagttcaaaacaaaatctgactacaagtagaacctccacaattcaaagttagaccaacgatctaacaacaactcatcaactagcaactatcattgaactaaacaatccagaaggacattacatcaactcattcgtgaatctccaaaagaaataacccaagtaaatttacaatctactctttaattataaataaactgaagtaggtcacaagg

SEQ ID NO: 2908 - DNA, 702 bp, Human rubulavirus 4
  strain t146a296_HPIV4, complete genome.3
caaccaaggttcatactttatgaaattcatctagatgctccaggaaaagccatccacagtgatgcaccgaccctcatctcattgaaagaaactcaaaatcaacaggatcacaaccatcccacgacaacaccacgcccacaacaacgccctccaaaaaatgaaagacaaagccaagaaaagggaaaaatggaaaagaacacaacaacagacagagaaaaagaagaagaagggcaacattgccctggcaacatcactcacaaacatctcccaaccaagaccgaaccgactgcacaggcacagaaactcaacatcacaaaaccagaaatggccctccacaatcctcccccaacaatcaccaacaaaacaaaacgacacccaatcaaacaatctccacatttcaattttaagaaaaaaactattataggggggaacacacttctcagccctaactgtacaaggccttgccctgtgcaactgagacacccccacgagcaccggaacaagacccgacaacaagtgcagcctccacgaccaaaaaccgaatcaaagatccagaaacagcccatcgcccagccatcatcatagaatctaacaatccagaaagacgctacatcaacccagccacgaatctccaaagggaacatctcagacaaaaacacagcccactctccaattacgaataaactaaaataaatcataaga

SEQ ID NO: 2909 - DNA, 702 bp, Big Sioux River virus
  isolate S28 nonstructural polyprotein (GP1)1
gtcatctgggctacaactgacgcttttgagtgattaacccgcctttatatattattgccgattaaatactcatgattcttgtgtgtgtttattttggacaaggaaactagttctgaaaagactttgaagagcgcgataacgtcgaacttttagtttgtataaccaggagctctgggaactgtcgttgacaggaaattgagaccgttgtgtatgctttgtgatcttcaccgtctcacccacctacctggacgattgtcgtccttggatttgagcctttagaaaaggaagtccttgaattatagaggtacattagtgcgttgtctgccaaaacaggtacgtacggattacactataaggacgtctagagttgttcattttgcccccttaaccggattcggcgaacactctattttatatacccacccatttatagttaaagctttataacttaaaagtaagccgactggaaatcgttaatccaattttattttattttattttatttaatttatttcaatatagattattttagatatataagaccagtatttagctgccttaagcaactattatacttattttttgttattcttaaatttttaggagctaaggtagcgttattagctattgcacttttatttattttaggaatattgtccccgaggaattatttgttaataacactttgtttgtcattatata

SEQ ID NO: 2910 - DNA, 708 bp, Haartman Institute snake virus 1
  isolate KS111230Crimig20111
ttcaaaagagggtggggagttttctccccacccccttttggatacccatggtgcgggggtataaattaccgcaccccctttgctgtgcccagggtatgggcacctttctgtctgttttgtttcgtttgtctgctttatgtgtgctcgtcccctatagggcactcatttcagctttctttcattctttcttttccccggttctcaccttaccggaggcactggccgttgcgcccggcggggtcaacctagtgattagcactaggctgtaggtgtctaaagtggtgacacaaagaggtgtttcctgattccagcactgttaactgatacagatgaaacctgattgatcttctagaaggggtaggctacgggtgaaaccccttatcttaatactactatgtagagatagatccagtaggttaagggcagtggataaggttgagttcaaatggacaataaatcttcaacactggtggacccaatctcactggctagttgccttcagtgtggattctgtggaggggtgtttcttctggatagggaaccatcacactggtgcctgagactcagggtgtctggccttaaatcacagaagccgtatggtttttgtggcctagcttctgcctctaaacagactctggggcccaatgacaccctgagcccttcggggtactcaggggcatttaggttttccacatttcaaaatagtca

SEQ ID NO: 2911 - DNA, 710 bp, Sanxia picorna-like virus 12
  strain SXXX24153 hypothetical protein1
actgcatctattttgccacgctccacattggcccgtgtatatggctatgtgctctggattcgtgactaattcgcgaacggtttcccgacgccgcctgtcgagcgctttgacgttatcgtagagggtttttaaaagtcgatgagtggtacctactaagtgacacaattgatatccgtttctgttcgcagtactaatttagagtagtttcgatttattttcagcattgtgtccttttcctttagtttagtctccatgtcatcgccgttagtacacggggtgccgtttgcggaggcaagactaaccacttttcaggtcaatgagctatgattgactgaggatagcaagtacggaccacgttatgaatttaacgtgatttacccgaaggttcgctccaacggggttttaggcttgtgaataggctgccaagccgttctttggaacgttgtttacgatttgattttgaagcttgggaatggcgccttttgaaggccaaccactgcttgtttcttcttatggtctgatggggcgtttttatcaccccttgtctagaagcctatttggctttgcacgacttcgattacatgcaacttcataccatgcggcttttgcctcaaacccacttgggggggaacgccccgagcatcatggtggctctgatgtcataaccactatacaaaacaacaactatcatacaacacaacttaaccaat

SEQ ID NO: 2912 - DNA, 715 bp, Picornavirales sp.
  isolate rfb200shi2 genomic sequence.1
taaatcgtgagattgagaataaaggtaagcgagatgtagccgatcaaaatataaaaggtaattggttaatacaagatactaaaaatcgcggtctattagaattacaaaaattaatcggcagtcaaaaagaaaacataacgactaaagaaataaatggccaattagaattgttgagagagaaactgggcaatcaagataagtggaccgaagctggacgtgatgcattcactaaagctggcctcccggaatttactttctgggaccggggatctagaggaccactcgatatcggatcaacgcgatcatacatcggaggcaacaattttgtcaattcctatggaggacctgacaccaaactgcctaaaaccggtgagtcgccgttcgcagatatgaatggactatcccgcccgtactaatcttgttgctcataacatcgatcaacaatctaagctgtcttaagtggtttgtcgggtgtcgcaggctactgttccactcggggtcatggtgccgcgcttaagcgtttcactgtaaaaccatttcattcagcatcaaaaagaaaaatacctaggtgagcttaactcaccgtcatttaagctaaagttacaaaatttaaattaacttacgttctgttttcttaacctcaactttcaaaattaaagtaaagaattctagtaaagtaaatttcaaaatttgtcatccaaaaaaatcatggatc

SEQ ID NO: 2913 - DNA, 727 bp, Beihai picorna-like virus 87
  strain BHJJX25970 hypothetical protein1
ccatggacgcccctttgtaattcgtcgttgcatgtatttagtatgccgttatacgtattcccccgtgagaaacggtcgttgcgtgtattcctcatgctattatatgtattccccgttgaaggaatcctgaacccttattttacccatttacaaaattttctaaattttatatatttaattaggatcataccttttacatcgatttgccatacacaaggtgtaattgctatgataaccggaatgataccttccggacagtggaatctgttactttcccatctttaatcttcagatgtaaaatatagctagactgataccgtctagacagtggaatctgtatctttcccatccttaaactttggatgtaaactaaagccgccctgatatggcgtacctcgtggtgattcgctcccataaggataaaactatcaaggttctattttggacattttaacctaaagaaaaatgttctattggccagatcaatctcacttactcaacatttgtgagaggctatttgcctgtgcgttgtccagacccagatgttaatactgcatgacccactacactgtggaataagcaaaggaaatactttggtataaatacctccttattcttgaacgcaaccaggatttcgttccctggcagtgatatgctcatgtaagatctcatcaactgtcgcaaaggacttaaagttattatctctacgctgtggcttaatacaact

SEQ ID NO: 2914 - DNA, 730 bp, Apis rhabdovirus 1
  strain Apis/USA/A, complete genome.3
ggccctaagaacattgaccctgaaaacaatagacctactcatccatccatatccttctgaccggttttagccaaaaggagcctttaagaacaaatcatccaatccaagcaaaacctcactctagaccaaaaaacccaattcttctcctcaaccacctatgccattgtagtaatcttcccttctttccgcaatagagaccagcaataatctgataatgcttttctctctgatttccttaatatcacgaaaaacctctatgtaacggagaaaattacaaacttctaacagcaataattttttagatctcatttttcaaaaatttgtgtcaaatacaaacattcgataggtctcttactcaaaataaaataacaatgtctattaaagaaattgattaataaacactaattattaaaaaagaatgtttagaaccgatagtggtaaaaaaccattgctcacgaaagtatagaaaatttgagagagctgaaaaactgcattaacttttcgggtctattcaatacaacagtccaaaccaacctcagataaagcaagccttaacaatcaacaactgcgtcatagtgattcgaaaccgtagatccagcaatacagctcggcccggtaggaatttaaatccgagttactctaaaaatctagtcaacgacacatcaaggaaccatttgtccaaaatcagagtccccgaacgcataccacattccattaccaaaacgcaacg

SEQ ID NO: 2915 - DNA, 730 bp, Piura virus
  strain P60 hypothetical protein 1, hypothetical protein1
ataaaactatactaacgtattggcttatcaggtttgtatccaggtacagatcatagtcggtttccatccaggtgggaactgtataccggcggctcgtaaggcgagttgctgtaaactggtacgtagccagactacgtactgtaataactggagtcccgaattacgcgactctgtaaaccccggtgttccgctagacggatcactgtataattgctgctcatctaggtgaggagtgtaaactgaataacgttaagcgctattctcaaacaccacgacgttctttcgggagcgtcgtttaactgctgactttctagaaagtcagtgtaaaaattccgcaagttcgcttgtggatctaaaataggagaaactttcgaggtttctcccgtctgtcttgtgctcagcttgcttttgacggacagtgttgcacacgcgttgttacagaagaccgaattttgctcttctacgcctcgcctacgcttcacatctctgtctctcgcagccgcactgtcttcgtgctttgcgacttgatagaacaactgcacttccatcatttggaactgctgaggaccggacttgctcctcacgcacccaactcgttgttggtgcatcgttcttctttcgggaagcactgtctcactgtctccggatttcactttccggggtctgtctagcgctctactgagcccttctctcttcgtctcttggccaaggacgattatacactttcatc

SEQ ID NO: 2916 - DNA, 736 bp, Wenzhou picorna-like virus 20
  strain WZSBei68985 hypothetical1
ctgggcagtattgcccagcaatctcttaaggagtttctcctttaacaatatcgcaacaattttatgcaagtttggtgatgtctaaaaatcacccgatcctttctatcttgttctttacgacttttctataatattattttattaatcatattataggcgagtaatataatatggatttcacgaaaaatattatagttctgattatggtcattttagttaggatgtgccttatcttgttgtcaggcttggtctagccttgatagaccattttaaggtttagtctaacctctaaatggactactcaattgttttagagttttgttggtgttgctagccataaatagcacactcggattgttatccagcgtcattgagtggattaacttaagcaattctctctatataattttattaatttaattatacttactgtaaatgtctagacgtgtacttgatgttttgccttttcggaaagcgagtataatgtaatcttttgaaattaggtaaacctgtaatccagagagactgatcagtagatatttcgaatgtaacctttatggtgattagtagaaagacctttcattatgagggtcctgattaggtaaattattaagttcacggtacaactccatctgttttactattaaacatccagattgtaatcctgtttttactttaataattttattttcatctgacttaagtaaattaagacgttttaaattacttttattca

SEQ ID NO: 2917 - DNA, 745 bp, Plasmopara viticola lesion associated tombus-like virus 2
  isolate1
ggtttctagaaccgcttgaagaaatttcggccggctagcatggtatcctcccctcgaggataattctgcgaaccggtcagaaaggtggacctaccgcatatgcacaaacatgtgcgggggggctggtaatatccaccacaattctagatgaggccgtgtcccgcggtgcaagtaggcttggctccggcttcagcggcttgcaagggcgtatacgggtccgctcgtgtacgctaaatgggatcgcattggcatgtgcaaggtacatgccaccgcttatagggacagattgctgagtcccagttcacggaattgaacttcttccccgagaccggttgcaagtctcaaagggtcaaggttacgtgcgccttgtgtcccctcctaatcgcactactgcaaccctcatacggttgtgggagctcgaactggcacccacggtggtggaccggcattaagttggttcgagcaagtccggtcccagacgtgtgtggtatccacacgggtgtagcaaacacctaaacagtgccgcggaccgtgaaaccgaggacaacacgggttggcaacaccagccgccctggcagagggtagaaactctgctgtcacgcatctgacgatcacttcagtgatgccggtaagctaaggccgtaagccagccgttactccaagcccacaattcgcgtttgtgggtcataacgtgaggaggtcgcggaggcggttataactcaaccacccccccaacacaacaatc

SEQ ID NO: 2918 - DNA, 746 bp, Wenling sharpspine skate picornavirus
  strain DHBYCGS187421
tccgttataggattatttggacctctatattgattgacgagaggttaaacaatgtgcgtttgcttcatgatttattatgttgtgatcgttggtcttcttaacacattgatgtcaatcacccttttactttactttgtaactaagtttcatacatttctttgaaattctcatttacaatattgtcgagctgattcacatgtttcatttacttttactacaaatctaaatgttccacaatcatattttgtttattcataatcaaggttgtaagtattatgcagggcaacccacgcagtcaattggtcactcatgaagtggctgtggattaacgcctgaatgtatttgcttattaatatcttgttttacgaatagataaattatgtggtctttttaaactacccttgttgttaattgggtcgaatcatcgcacacataatgctattttagacaaacgttgttcgcgagtatgcacggtattggaccattattgcttgtcattagcaccattggtaacaatgatgacaatccccggttttcacttaagacagctccgcgcttcgtgctgtgtttgagccttgagtgttgacgtctgggatgggtggttgtgctccactttatctagactgtgtatataagttagcaagctgttgctttcttagcattatgtggtgggcccgaccacaaagggcggtgggatgtgccaccgtaaataatcatatcaaaaccctttattttaatatgtagac

SEQ ID NO: 2919 - DNA, 748 bp, Beihai mantis shrimp virus 4
  strain BHXG23944 hypothetical protein1
catggtagtacccatgcagcgaatctacgtaaagtgtaattaactgacacacagtgcccatcttttgcacactgtctcttagtttttacatgtagttttaatcaaagtacaatttctattagtttcttctactatccttttagttttagatcaaaaccctaaaaactattataattttaaaatccaaaaatattctagttttaagtgttgagctctaattgtgatacttaaatggaaattgattgcgttggtgatgattttgatgacggatgtacctctattaggatcaagtatggcgacatactccttttggcacgggaaccctgagaatgactctagacaatattaatagaagtttttgttgatctcttatctcacctctagcgaggttaaagttagtaacacggttttatgatgtgaagctcttctttctcttttctcatctacgagattcttttattttacttcacattatttatcgtagttacggcaatacgttacttctccgggtgttatggcgtccggtaagttaggtatatgtccacgtagtaatgcgtggagtccgccttgtattctgactgtggtgagtataaggtgcctaatgtggagactaaagcttattgcaactccaatccacggagcactttacttaacgtatcgtctgttgctacataacttgatacttcacgtgtagtaataaatttcttgaaagtatcgccccttttctttcttatatggtgacaattat

SEQ ID NO: 2920 - DNA, 752 bp, Rhizoctonia solani hypovirus 1
  isolate BR20 polyprotein gene,1
gctggctagaattttaaaagaaaacttgcgtaggtatgaccgcccaccatcgcgttagcaacgtaagcggcacgctccttccttggaaaagaaggattctaagcgtccagagctggcacctaaggaggtgggcagtcggaattcggtgtgtcccggaactgacccttgggcaaggcgtgagcttcactggacctgtagacgccccggtgtctccatctctagacgaattttcctgacttaaagtcaactgtatgctacccgagatgttggaaggggaagctagaaccggggactcccggcatgttgtatacgctgaaaccgtaacgggttggggccgtccgcgcctttagctgttaacacaacatgttgggtttgccaaccgtaatgggaaggcagcctagcgggcctttaggggcgatgctttggtcctcccgggtgatgaactgtcttctgattggctgcgaaagctgtaccacagatgttcaggggattcatcgggggttaaataccggattcttccttctctcgtttcgggctgaaaccccgcagggaatgctttatggactttcaagaaaagtaccaccgtgatggaccggagatccaggttaccagatgtggcagagcttcctaaaagcggcgcccacgcccagagtacaacgactattacacgtataactcgacggtgctctcagtaaagacgggacactaggcattgaattcaagatttccgacttcccaattctcccttcgcc

SEQ ID NO: 2921 - DNA, 761 bp, Beihai picorna-like virus 100
  strain BHNXC41148 hypothetical1
cttctcacgctaaacgtatgattcttttgactttggaaacccatcctggtacccgcagtgctatgctgttcagtcattacatgccaaccatgcactgctgcactttgatgcagatgcccatggttgagatgcaattgatcaaagcagatgcccactgatgatattcagtcgtgtttccatcgtactcacgagttatcctggtgcccacaacattatgttattcagtcctcttgtgccaactatgctatgttgcacggagatgcaaatgcccatagttgagacattaggatcaaaataaatgcgtgttggtgacattcagtcaacaatctcacattctcaaaaatttcacaaatcacaaataattgctggtatcaataaatttgacactggtgcgttataatctaagtatgacttctggattccgaatgaaggcctaaaacctgatgtgcttgaaggaagtctagacataaaccggcgtagattcggcttgtgttggctgcacgagtaacgattacaaaggtgtaaggtcaaatacttattttatagtgtcatcttttgacaatttattggtaatttgcggtagtgagctaagtatggtccagcaaagccatcttagtttgaaacagatctaccatatattaaactaattcctatggaatcttgtatggatattggcgaaaacccgatacacgtagtagacggctagtagtcaagtaaatcaactccggtcgatagttatccattgatttgggtagcggtcc

SEQ ID NO: 2922 - DNA, 761 bp, Wilkes virus
  isolate Antarctic11 polyprotein gene, complete cds.1
agcatacatgctatacccaaattttaacatcttttcttatttattctagaacaacccgtgagacggctaacccccgttgatcggcatccctagaatttagtacataggggatgaccccctatggaaccccaagggaaccctacccttacccaacgcacctggtcctcatgcgtttaatgatgttggcaccgcaaccttgcggccttgctggtatcaatggacccctaccacctaacccactcacttgacacatgtggttcgcccacgaaaccccctttgtgtggctagcgccatctgagaggagtgcggaactcccccacggtaacgtggcccgcactggcctaaagcctagtgtgcaaggacacatgctggtcggttgtacccacggcctgcctaccatgtgtcctgaagctcaccgctcagacctcgatcccggagacacactggggctagtactgtgcgcgccgcctggaccaccaagtccttgggcagtgcgtaggactgccagccttagtagacccccagcaggtacccccttggatctgagctgggccctgtgactataccgttccggtaatgcagggttagaaaaatgaacgggttggcaccacttctcttctctttttcacctttttaatgcagacatcaatggttgtattggtttttgcaatcttcaccttggctgtgatattcattgctatctgcaatctcttgtgcattatcctctggtgtgggttttgtgctgaacctccgctttcact

SEQ ID NO: 2923 - DNA, 764 bp, Macrophomina phaseolina double-stranded RNA virus 2
  isolate Mp32
tttggaatgctgcgctagctgcgactgcccgtgagcattccatcatcattttctctcgggtacttcagctctttgaagaacctgttaaggcagccgttacagacacgttggcccgtaggagctttaaattgaggggccgaatcttttatgcattctctgaaatttgtgcagagtgggacctggctactgctcctaatttagccacgcatgagaatgagaaagtggtgaaagccattttaacctatatctttattcaccccactcctatccaggtatatgaatatataccacgcttggccgtgaatcactcaggactgtcatctaattttaaacttagttatacgagaaaagccattgaacaggtaaattctcacacacacacacaggtgggcaaatattcttattataccaacgattcgggcgtattgtccagctgcgcgactcgagtttttaccttactcggtattcaatgggagcactcgatctatgatgctgttgatcctgctaagtttggggtgatagctgatacttttaacaaatatattcgtagcagctggcatccaaagttgcaaatcctaacatattcatattgctacgatggggaagtaccaccgtttgaagggtgggagcaaggtgacaaagaacttttattatttgtgtataatgatcatgtagcctatgctttgcggcaggacatatgcgccaaattacaaaagttggatagtgatctacgcacatacaagtctagacttgctattaaagag

SEQ ID NO: 2924 - DNA, 767 bp, Beihai picorna-like virus 5
  strain BHNXC41415 hypothetical protein1
cctgcagctcttatcgatgttgattacttggtgtattcacccaatgtattttgaatattcagaatctagcggtgtacgtcaccgctttattttggtataatattcaagatcattgttatagtagttttcgttgatttgaacttattttacctccttatatttctgattgaggagatctttagtcaagatttatcaaaacgaaaccttatttgtcttgtgcattcaggtacaccccctgatgcgtattcatttttgtatattattgaacatattttatattttatatattgcgtatccgacgatcttcggtttacatatatagtaaaatcacaacgacggtatctactgagactgtctttgtatgacagtgtctctttaggagtccgtgtctagaatttgttctaggaaattcctcgttaatttgttacgaggtcttctgtttttagatgatttttaatttggatggatcacctcttcctatcttgtgatggttcactgtcctgaattcttacaataactctatgagtactattggttttcattatggatataactacagaacttgagaagtcgaggtttgtcacgcagaccaactgtaagtcgtgtgtgaaatctgatgatttttgattcttttaatggaaaagtgaagcgttacagtgttgttatgatacttggaccctgagaagtccacatacagctgaacgtgtataatgctcgttacggagcatggagagatccagtgaagtaactattcggttggctccggt

SEQ ID NO: 2925 - DNA, 768 bp, Biomphalaria virus 2
  complete genome.1
cggagtgatcttttaataatatagctaggtatgcttatactaccgaacagtaaggtactactttacaggcttttaatagtgcgtattaacacgtcgctactatttcataataatatgtgttacacaggtttagtgtagataaactttttatagtgcgttctagattatcgctactatatcatatgaaaatctatttagttgattggacgtaatttattttaacaatcctatttttagttttagttttaactatatatttattttattttattctacaactcgtttgtagatgtcgacaataattcattaatggctgcgtttcctttcagtttaagcatgtaataaagtagtgacagtgatttacatgatactttgggttatgttcccctcttttcggattaagtcaaaacacgttttgcgactctgccgtgtaagcagaagcccactgattttctaaattttcttttgattaatcacatacaaattttatacaaacatgtcgactcgtgtatatcacctgtctgttaacctctatgatcttgcctatatttctagcgtctatgaccacttaattgtgagcgatataggtatttttgattatgttagccttatttgtataatagctgttgagtttaaactttagtggagtatcccctaacgttctgaggattctttaaagtgaaggccgttcgcttttatgcgcgctatatgtggtagtaccaacttagtgttaaataacggaggtccacatgggagaacgaacaatca

SEQ ID NO: 2926 - DNA, 770 bp, Trichosanthes kirilowii marnavirus
  strain pt111-mar-9, complete1
agacaataacacatgcgtgcggaactaccgcacgcatgtattattggcgaccttggaaggtcggccaaatttggagtctgtgactccctctttgtttaaatgttagaattgaacctgatttgtttaccccgagacctcacttgttcaagtttacatttgggcattcttgggattacacttcggcagcctttctagacatcactttacactgaggcaatagctagctccatcttttctaaatccgatgatggtaaaccatcacccatttatatgtatagtagcgtgtgcccttaagcaaggcaagtcaaagtttactggttatctttaaaacctttattaggactatttcgtcgttgacgcttgcagtaaatcgagtacgcttcggcggtaaatccgtacatctgtcaagatagttcctgttgtaggagacaaaagctacaaacaaactctagaaaaatcttcaaacacaataagctcctataacgaaagcttaggtcaaatattaagcctttccccaaccctactagcaatccacgcaaacacctctccgctcctattggacgacgtgaaaagttaagtggtggtaaggtacagctgcagttgcagccgaggcctgcctggcaaggtaataaggattggcccaattgtggcctatgtccggtactccggtagacttcctggtttgttgaattaaaaccaggtgcggcaatctaggggccaaagaaaacaacctatttcagaaacagagacaaccacaaacgacaacgcaa

SEQ ID NO: 2927 - DNA, 781 bp, Pineapple mealybug wilt-associated virus 2
  strain HTS 2, partial2
gcgagtgtcatttttaaatatttttatttggtttaagccgatgtgtagctatttttagagccaatactttattcgtttctttgcgtaattgcctgatttgttacaatgcgcaattttgtttagcgtattgtcattttttgattctttattgcttgtaccgtcatgtgaatattagttgagcttggttttcgggttttaggttgtttctaattaatgttcgttttgttttgtacagcttcatacagaccctccgattatatcgcttgcaaggcggttagtgcggggacacggggggggtcttagtggtgatgttggcctgacacagtaggtctcctcacagcatcacacttttggttgggagaggagtttgcgagtgaggcgcatctcctttgtatatatacgcgttatattgttgttttaattatagcgttggtattactattataacatattctcagggttttttagtttatgttagtttataattaggttttcttacagttaatataattctattttttcacgattaggtattggctctatcttgcgtagagtggtagtattgtatattatcgattgtagattgtcagtaacacgagatgatatgagtgtatacattaacagatgttagacgctttcacagccataactatcatagcctctttaatcttagcttttctttttctgttgatactatttatagtggtactagtgtataattattattctagaatgcacagttcgatgcgatcgtatggagcggcgtaagtagtcacgacgt

SEQ ID NO: 2928 - DNA, 787 bp, Atlantic salmon paramyxovirus
  isolate ASPV/Yrkje371/95, complete1
accgacctaggatagtccctccactggagacctcaacacacataatccgtcaagcatcacaccgaggaggtctccaggaacacccagactatatgaacagctgatccacatgtctcgttctctgctctgtcacattttcttataaataaaatatatctactgtagttctatacttgaattatttagcaacaactatctcatcagaggcttattcttagcgggtctagatatttgtgtgtttattggaaattgggtcagggttttagtagaacactcgcgaaaagcctctgagagcctatctctaaaagaacgtggaacaaagccagcaatctccagaaggcacacgtgcaatgtccattccaagcttgtaattgctcaggaatcgtaaagcatacatgaatcagtccatgagtgtcaggacatcaggtgatctctgtgttgatatatctgtcggttgtacttaaattggtgaccttcaacgaacacttaaagacccggatatttagtgactttgcacattcactaacgggtaactcaagccagtatataaaggtcttactggaaaatagttgtatgataactcgcacttatcatgtattgtctaaagccgttatagattacgaaattatttcggatatgtttgttagttttttgtctttatagattgagatatcgttgcatctcgtttatgtcacttgtcaatggattaaagaaaacttaggatcaaagcaattgatatctactctagttgataccgactactttgatctttttcccatattagcaa

SEQ ID NO: 2929 - DNA, 804 bp, Wenzhou picorna-like virus 16
  strain WZFSL67369 hypothetical1
gcgtagaattcctctacggaattctacgcatgtgatacgattttatcggtcatccctgcaaagggtttatttctagtcatgatataattcatgatattgcgccgctttgtgtgttgaaccaaattggcgctcccaatttgcttctatttcacatgaaccgccgtaggtatctatgagttatattatgcaaaattcggccaggcccgatccacctggccgtcttatatacggatcaccccctatttgttatttgttcactgtatgtgttataaaactaaacaatagtggtgttggattatatccattattttaaatcataaaaatgtgtgttgtatatcatcattatatattcgatttggcacatctttttaccatttctttgattgattatttgttagttgagtaatttccaagggccccctcttcggaaagacgcttaatgagcatacgaattctacaattgagaatcgtttgaagttgtttgattaactgatcgactagctcttgcttttccctctaggacctgacgacctcctattgggaactgtaagatactcgcaatactttttcatgggtatgtgtgagtttttgatgatcctgtattttgtggctctatctagagtcaaccccctgaccccagttatgtgagtcaacttaaaatgacaaactccataacatttcttatgtaagcctaagttggcaattagtgaaataatctttttcgcttggtagaatttcacacacgacaagtttgtctactaaagcaaacaatactgatcagcttgcagatcataatcccgatca

SEQ ID NO: 2930 - DNA, 805 bp, Plasmopara viticola lesion associated totivirus-like 1
  isolate1
tctcggcagctcggtttataccgcccgccggggcccctcgtaagaggggtgacagggacacgatatgtgtagcgggactcgttcgcgggtctcagaggatcggtgatctgatttcccctttccttctcgaggtttcaagacgcacaatacctcgatgcgatacgtcataaccttggcggttgttcctttctgacagccggggcataatttgacgtgttaaggccgcaagcgttgttccgggcttttggctgtatctttggatcggtactgatacaggtgatgagctcgttaaccagataggaggtgggttcacgtgaatgcgtgtgtccacgcctaggctggcaagtggcaatttatttacagtgatctagtcgtctaagtggtgataatcctccctaacccacacctcggagcgagctgaaattagacgagtagagcatatgtttaggatacaggcgacgggctacccgcccggcaaggaaatctcttcggagaggcccgccttgtagaggtatagttacgggcccgagcgattccgacgaagtcgcgcttggctgcctcccatgccttctcatcctcaggctataacggtaaagatcacccgttgttgttaagtgataccgataaaagagcgacggtacgcgtatctgaggaatcatagtcgaatgtaccccgcgtgaaactatgtcgttcgaggtccgaacatatgtaaagctcgttttctagaagttcgtgtctatggttaggttagtagttaggttagttggtcgcctcacccgttagttggggcaatctcccaaaaatc

SEQ ID NO: 2931 - DNA, 827 bp, Halastavi arva RNA virus
  complete genome.1
aaaatgcgaggcatgggttaccttcccatgccccctccattttaaacaacattatttcaacattttgtgttttatcagactcagtttattgcgttactaattagttttgcgtttatctgcccccgtggtttagcactttatgtgtaaagactcttgattctaaccttgccgtatggtgccctaacgggttcatttaatcatgcgatgagggttgctataccgcatccattctaaggcgattcaatgcttcatttaggaattttgttgacgattaaaaggtacccccacaaaaacaaaaccaatcttacttgattttcgttttaactgaccactgcgatcccaaattttcgccttcttatcaaagtatgttgtgttctttgggtgtacaacctgagaacttgtctacaactacatattactcgaggaagaaattcggtttaagccgtgccttctcacgtttagtatatctatctagacacaccttcttcatcttctaatccccatctagtctcctgatcagagacgtcgttattaacaaataaccccccttgttaataagagacaaagtacaatcaagctaagttctcttggagttcctgtaggaacttagccattgtgatagagtcataagtctatgtgcatagacagctctagctcaccatttccttcccaacccatcttttcatcagcttaactctatgaatccgatgcaaaaaccattctaacatcttatggtgctttccaagccaaatgagagctcactcttttgagccgctatttaatggacaataaacgttttatagtgtacatcatattgtaaaaacaaa

SEQ ID NO: 2932 - DNA, 828 bp, Sanxia picorna-like virus 6
  strain SXXX37597 hypothetical protein1
catatgcggagttctgattttagttgtcatatatagtttgggtaaaaacccggtagtagctattacgatggctattacatggtttttgcttaaccgactgtatatgggtactaatgacgagttcccataagtttacatttttatacatacgtcaatcccacgacacgggatagaattttcgaattcttgttaaaacggcttaattggctgtattgttcatctacagtggataaacgacccagcgaccctacaatttcggttcgtcttcgatatagactgataaaaatattttagtaattttaagacaaaattactgcaacgcacacatgtggttgcggcgcactgcgccatttgatatagaccattagcctcaggtctagaaaatgagggccatgtcaccggcaaggagatattctatggggtagcatagcccatagtcttaaacccgtgctttgattttagatcacaactacaggcaataaaggacatatacagttgcctgtacccacgacggcgtagaatagtgaaaatgcctaagtaactattcgtaggagcgtaatgaacttgaggttgatgtgataggtgtgattggttagaatcacattgtaagcacacgtacctcccgtccgaagccatgccaaattgagtatggtggaaaagtgggacaacaaggcgtcaacaacaaaaccaaagatttctctttggcttgttgttgactctttgttgtgtttgtggtctgcgaaatttagctgaataatagtaggttattaaagtagcagacctttacaaatacaacaagagtcaataacagccataaagtacagcgta

SEQ ID NO: 2933 - DNA, 833 bp, Wenzhou picorna-like virus 10
  strain WZRBX43164 hypothetical1
agagaaccatggaacatcccgttccatggctctcccttgctgattgtagtgtgtcgttttaccgcgacacccggctacatcacatatattcatctaagcttaattgctccttttataaacagacacaagaactgataaacaggggcaacccccttgtttactgcgtcttaccctgtaacaggagaccgtacaggcaactatttgttggctgtacgaacctagcatttgaattatatgatatttagtcaccataccggattaaaaacccgttataagtgacaagcgcttgagtgtagatagttgtggctactatttactatacttttgcccttgcccaagagagtcaactctttttcaaatcaagccccttctggcacatttgtgtttaggatatgcggaacgtatcccgaatcactatgtgtcataaactattgctccgattaagatgtcaagtatattaatcgcataattaagcagtgtttggttttgttagcagaagaatcccccctactagagaatgatttcgttttaacgactgtgcctccgcagaggactcgcacagatctagatctaacaactcttttaggaagaattggtcttttggtacattttggatgctgatatacgcatcacaaactatactgtcgcaatataactctttataagtatgtttacttcctgacaacctgagggaagaggtttggacacctaaattttccataccgctgtactgagtttgaggttttgctatgattatttatttgatggactttttggactatagttttggttttgtttagcctgttgaggttagttctacgcctactaaaatt

SEQ ID NO: 2934 - DNA, 838 bp, Gysinge virus
  isolate OTU22 hypothetical protein and RNA-dependent1
gataagaacgttatctttttccttctttgacaattttcttaagtttgaacaatcactattaaaaacttgaacaatgagaaaagacactcctctaagtttacctctctttaagatcttcattatcattatccactaaccaaccattagttggaaagtcacaaggtgatatccttgatgtgtcgtaggtgtgtattgttagcctcattcactccgcattatcacagaattgtattaatattagctaaattgttcttgggtcatcaattgtcctgtctgaactgtttaactctagtcgtccatatcctagaagttacaactcgatcctattattcatccttatctcaatatttctttgtggtgtccgcgtggagtcttatattggagcatttattgtcgaatccaatttccttacagcttctagacaatcttgatctctttcttcttgtatccgatttggctcaccatttgctagtcaaacatgcttgtgctgggattggtatcgctctacgtatacaataaaattacaaggatgaccatgtttgaagtttttgaaggatcagaagttgatgaattattacgtcttaaaatagagcaagggaagcttgaccatcatgatcagattatggaagaaccaagtgttactcttgaagattacctccgttccagactgttactaccattccgtgtggaaaatgatattgttactgtagtcaatgatagaaaactcagattattccatcacattcagacaaatccgatttctgaaattgaactaactgccttagaactcttgcaatttttctctactctttaatgagaaaagccatcattttaaagt

SEQ ID NO: 2935 - DNA, 838 bp, Beihai picorna-like virus 73
  strain BHJJX25960 hypothetical protein1
ctgggggccaaccccaggaggatctcacctttagaagtgcgcgaagcgctgtaacggcgttagtgaaccttgaggataatttctatttgtcaaacctaatcattggagtgtgacggagccttaggccactagtccctctttggagcggcgacctggtcttgaagtcctcacctttgactcaatacagtgccttaggccactagtctcctacgtgttgcgactcactgtgacggtgttagtgactgtagacggcaacctggtcttgaagtctggagaagttaatccaacatagttcaacggaagaaggtgtgatgtgtcttttaaacccctattgtatattaacgtgttacaaagtaataatgtgatgtataaaaagctcttcaaaatggacacctggtccaccaaaaatatacgtgtaatctatctatgttttcttttcttgtttccgaaattccagttagtgctacaccttagacctaatctatcaagtcggagtcggaagtaacgtgtttagtacagatttctggaacgaccgaagtcgactaattctagtccggatttccgcctacacgaaagtggtggttggatacgggaaacaaagtaagcctttagcgaaagcgacgaaagtcggcctctgctctagaattgtcggagttactgagacgtgtagtattttctggtcataccctatgggactaagaggcaggtgtccccggtttcaaggctaccgaaaaagtccttttgataaaactccccaaagtgatgaaatattttaactcgaatgttttcttctcgcacatgatgtgactttgttaatattgaacgaataactgacaaa

SEQ ID NO: 2936 - DNA, 839 bp, Wenling picorna-like virus 3
  strain WLJQ100015 hypothetical protein1
gggtgttttcacccacacacttttaattagggacttattagcaaacctctcatttcgctccttttcgctatatgccattacgagccatttcatgttaattgcttttattttcttgattgattgtgtaatcacatcttatttatacccattgactccctttctttgtcaatttctctttctcatacttcatttgtacatagttatgcttatatagaggtgttctactccgacctttctatgtacccttcttctagtttagtatttctagtcagaaaaataccttatataccgttccctgtatctcttgggaatttctacctgtatatttttccgttttaaggcttaggctttatatacagtgtatttctttcttcttcctaattgtatattttctccgttttatgtttcgtttgtctccgcacgagatgtttagctatgggattttccgaattaacgttgtgaagagcgtggtggtttttaccgaccatttcacgtttcatttcgacttggattttctctacggcgactattgtgttatatgtattttcctgtttgtatgaatgctatgtttttgtttgtattatgtttctctgtttgtaatttcaatttctagacaatcactttttgtttcattgtgtactttagcggttttctgcccgccatttgaatttagacgatataagttagtaagattttgtcacaaatgctttattcccgcgtgttatcgcttcttagccccgtgacttaaaaactgctttcttcagtctttgttcttatgtgaagctattgtatgtgtgttaactggataattttgctagcccagttttcatacatacgag

SEQ ID NO: 2937 - DNA, 850 bp, Kornilov virus
  isolate Antarctic39 RNA-dependent RNA polymerase1
gaataaagcagttgatgccccctctcagtatgagggagggtgtgcccccccggtaaaacggggaagaggatctgccgtccagcagactctggaattaaacatcgatgagatgaagcccaaacttgaaggccccaacaacagcgtagtgttggtggttagcaaggatgtaggcggtcaaatcgattttctagagccgactggtttcgcgggtcttaagcagaagcttagtgattggtcatcacaacgagtggaagcaaaacatgatgatgggttagtaaccatcatctcaagtgcccttcacaatgcgccacgcgctttcgtgggattgtgggggttgaaggatgaagtgacaagtgatagtgtcattcaatcgatcgtggacggagaagtcatggtcacgcacttggaggagaaagatgaggaatctcctaacactactaagaaggtcaaatccgttgacctttgcggagacggcgtaattgtcgttagaaccaacacccacaagcgtacgaacaaacgcacagggttccgcattccagtgctagctggagacgtcgctgccaaccttaaaggtcggcacggattcctggaatacaatccagacaacgtaaagttgatccgtgctgatgctgcgcgaaaggttgaagcatggcgcaaggaaggagatgcggaatggttaaacttgagaggagttgaagccacccgaatcatcatgcatgcggctaacatgtactggcttttgtctcaagatgaggcagatgtccaggaaatgtacaacacaagccacatgcgtgcctcgcgcgccgcccggtccaagatggccggtgcggcccctagatgctagggccgc

SEQ ID NO: 2938 - DNA, 853 bp, Beihai picorna-like virus 43
  strain BHNXC41212 hypothetical protein1
gtgtgcaatatgcgtaacaccgcatattgcacacattaaaagttatatcatacgtttaaattcgataaacctcaatttacatgtgttctttggtaaattgatgcacattttaaagtattatagaatcatagtttatatgatctgaaatatcaaaataatttgtaatcctcacagattcttttattatgatacatgtaagaacaaatatgtatgtacttctagatattttaatctacacaactttacacatttataggatggatatcctttaaatatccaaaacaaatatacacatataaacacgcacactcattcatgctaacttaacttgttagcaatcatagtcgttacacattatatgtataaatatttgatttatgcacatcagaattggtttttactaggttcgattcctagctgatgttttaaagttaaaatttttatactacatcacatctcatgctgtattttaaagttcacaattcacatattcatctttattttggattgtttaacaaaattccgatttttaccagatagttttacggaaattaaaattagcaatcataccgtccttgattgttatttaaaataaaactactgactgctcaagcttcgagcgtccataaggagatcatgaaaactgttgaagtaattcatataaatttaagtagaagatcccgactgtgtatggtggtaaagatcacccatcatatatggtaggaaaattacctactttatttgtacggacagaaaagacagcgcagggtgatgcctgatagtgattggaggccgatgattataagccttctcgaaagagagtaaattatggatataattggacaaaataccc

SEQ ID NO: 2939 - DNA, 856 bp, Wenzhou picorna-like virus 9
  strain WZSBei69430 hypothetical1
tgtatgggtatttacccatatagagtctcctacttgttggcatttcgttgtctgtttgaccgcagactcggctttcttgtcaacctattcagtcttctgagaatgttgagcttcatgcgaattttcttagaagattcgcatgctagatttcgcagctcctagacgcgttgattaatacgtctagagacacattttgagtagtattcatacatcctaggtcaccacaaaatctttgtttttgatacgttagcatattaggatgttatgctgtattttaaaaacagagtgcgcacctggcgtttccaggtccactttcaccgcgtggtcacattaaccgcgggaaccaccttatttggtgtggcattatacgccctcgagagtattttgctttattgattaattcaattacaatatcaaatcgcattaagcgatccgagcactcaagtttaaaaaggaacccagagcgccttgagacattaatattttagaacctccttttggagtggcttagcacgctaaaccgtaacggttgtaggccccaacatcaagcatatatcattttctcttgataaattacacagtgggttaaattcccagctggaagaaatgatatttagaattttgtgaggcaagcctcccgagcacattacgttacgtcctaagtaaaagtattatgagaattagccttcgaacgtcgtacaaactataagctacgatatttgaaattgttttaaatctttaactgcaattattctttgtaaattcaaaatgaacatacttgattaaaattgttctgaagctgtacccagcagcactaccagcctgaaggtagtgtgttattataaggcaccttttc

SEQ ID NO: 2940 - DNA, 858 bp, Picornavirales sp.
  isolate brb030urn1 genomic sequence.1
tggccactttagcagcactccttgctggtggttttggcagcgatatactcggctcgtatatcaaaggccaaattcagctcaacaatgcagagagtctcgagcagttcaaacaacagacgatgacaaatgctggaatcaatcccatgttggctgcgatgcaagctgctggcagcggcggatcagtgatgtccgaccagatgaccagtggcatgctctccaacatgtccagcgcagtgatgttgggaggtgtaacaacaaaaggaatcctcccgtggatgcaaggtggtcagcttggtacacctacatctgtgacagccaattatggagggatgcgtgtgacagcttcaggaagtccctcctctggcacctcttcatcgaaccccctaggggcttacagttcgatgcctcctcccagtcgaccaacttctgggaatacttatttcaacaacccatccaatacgacgaatgtcagtggcaattcagttgccttcgttccatcaagtgcaggaaccgcagctaatgaaagtgctgcacttgtcactggcaatccccaaccgtctatgacaaattctgagtttcagactgcgaacccatataacagcgctttgacgtcgtggggttctgaaatggatgttcgaaatcctggcggcctcgacacctctgctgtcggagccagtgatccatccacaaccgacgtcatgtccagtgatgacgcagtcgcggcttctggatcgggtttagtttctgccattggctaaactacgttttctagaaactgcgtttggcgacgtagttttctcaatacgatattgagcgtttcttagtgataccagaaaaaacaagaaaaacacaaaaaac

SEQ ID NO: 2941 - DNA, 860 bp, Hubei coleoptera virus 2
  strain QCM76287 hypothetical protein gene,1
tgagccccggggggtcatcccccccggactccgttcacttaagtgtgggcttgccgaagcagggactcttttcaccgtctgtaaaaagacaaattttagtttgtaaggaccttagttttaagaccgaggccgtaatctcactggataatcgtagtatatggatcaacttaggattgagatgaatataaaataaatgaagttggacagtgtctctatattaatatagctgtagccaacggacttgcttatatgattgccaattctttgccatagcagtattaaacctgcacagattattatcagtattatctagacttagtttgcggattcgacacccgtgtggcgacggctctaggtatacgtaaacgcccatagtcagtaatacggctattcctttaaggacatgcactgtatcaagaaaggaccagtgtcaagtgtgatatatatcccaacgaccaaacccccacgatacacaccccaatgtgcaaaattgtattactagctgcttatgctaattttcccaaataagctattttctacttatataaagtagatcgttgttagagaactaactaggatcttagtatgtagatgggatgatacgggaacgctgtatttcaaaggcatgtattttggtacatagtccgtattccttgaatctatttacgctaatttctgaaaagaggacctgtctctataaccagtagtacctacagtgccttacgggttaccactatgaggacagagggatttgacccgcagtgtggtaatattgggcgtagtcacgagagtcacttggcttcatatcgtgcttaattccgttaaacggtcgccctcttagatatttaaaaccatatacc

SEQ ID NO: 2942 - DNA, 865 bp, Soybean dwarf virus
  isolate IA-1-2018, complete sequence.1
acgtcattcccgactttatctcttgctgtgatgttgtccaggtggacactggtgaaaagctcccttctaagaaagataaagaagggaatgaattgccgcctgagcctaagcttaaaatgtttagaagggtgaagcctgagcatgttggtgatgccaggaaatacatctgtcaacatattcgcaataataatatgaggttgatagacggctctgatgtttctcatgcaaccatcaaccgatatgcgctcaagttttgcgaagacttggagcttgatatgaccagcactgaaatgctcatcaaatatgctatggtcatggtcccactccctcgaaaatctgatattgaggctgctaaaatcgtccaatctcctgctgccaggcaaataaggcatgagttgggcgtgcttaacgccgaggttttttagaggggctctgctccgactctggttttgaatccccgttttctattttggggttgccagagatcgtggtgcgaagtggggctatccctaggaagagtcgtagtactattaattatttgagtcagtttagtttaggtctagattaccaatgccctaatcccagtttgcacaacgcattggtggcggttgaacgtagagtgttcaccgttgggaaaggaaatgaggtagtgctaccttacaagaacataccaggaatcttctctaatcttgattatttccgcaaatctattgtggataaggttggttgccccaggacgttctcccctgaagaacttgcagcgacgtatcactctggtaagagaacgttgtataatgctgctgttcaaagtcttaaacgtaaggctgttgagaggagtgacgcgaatgtgacagctttccttaag

SEQ ID NO: 2943 - DNA, 870 bp, Hubei picorna-like virus 27
  strain QCM155345 hypothetical protein1
atctcatagggtgaacccctatgcacattttgaaatagtttcaacttatgttggatttgtttgacttagtaatgaatttgtcaaatttaaaaggtcggaagcatgaaatttattggcgtatataattatataattgattggcgttttatagaattcgtagctatatcactgatttcaattatactttgtatacaggaactctcagtggttggttaactgagctgcggcgatactaaattgatgatattttgattactgattgttgtaaatatttccaatgtaaggctttatatttcaatgactcctggaaagacaggtatggtttgaaaaccaattttaggtttaagatacttagcgttgctggaagtgagtactattagtgaagtactggacttttagatgcttattgagatatattagaatatgtactagtacctctatctgatattttcaacacataagttctctctaagaaaggtatggatcttcctcatggaaaccaaggctaaactgttaaagtcagtctgtactgaggtacagaagatctagtcccgtttatggttagcatatacatatgatgccgctttgtaacccaaatgcgtgcgcgtgattactgtatatgtccggaagcggaaaacacactctagatgattctcgtctggtgaagtacgtacgtctgatcatcctatgagcatgagctatctggcaatagcgtaatggtgcctcctaagtgctactttgtgggagtgaatctcaatgtcccgtaaaacggatacagtgaaactacacatcgacaataggcattgcggtacggagtataccttgagatccgcgtcggagcggtcttcagtgtgactttcattttattcc

SEQ ID NO: 2944 - DNA, 877 bp, Picornavirales sp.
  isolate trb102shi1nc genomic sequence.1
tcctgcaaacgcggggggcaaccacccaactgctacaccctgcacaaacaacaactaaccagcaaaagagcaaattaatcaacgccaagcatgtatgacagtctcgaggacgcgtaggggtggaaacccctacgcgccctcgagactgtcatacatgcttggctttgattaatttgctcttttgcttgttagtttttgtttttgcatggtctagaatttgactacttccccccctcttttgcactacgtgccactgtttttcaactttggttagttttgcatcccctttctccgggaacttgtttcccaccccctttttgttgttttggcggctatgttgtggcttttcaaccgcagtagcagtagacagaagaagttgagaaaacgtaagatttattagtaggacctccgaaagtaaacccctgcgcactactctgtgatgtccggacgagctatgtaaggagattcatctaaattatcgatttggacgtttagtctgccgataagcatttgtttttcccaacgtttgtaggtattcacaccccagacttctgaccgactgaattacggatttttctttttgaacaatggaattgacttgacgaagcttggctgctctttgttgtccagtgtggcatttgtaggtgtacttaagtgtatgtttacatttgtgtgatatcaaattcacagcgcaaagacaaggtttttcaaagcgtgcagtttcctaaaaactgatcacaaggtagactgggcatgcctctattattaggccaccataagtccttttagtatgcgtgtcacgacgtaccgtccatcgcgagcgaattccggagacacctcgtggatgatgtatgcaacttccggcccaaggtgaaag

SEQ ID NO: 2945 - DNA, 883 bp, Pingu picornavirus
  isolate 991, complete genome.1
gtttacgtttcttttacctgcacgttcgcgtgtagggttttcttgcaaccactatggttcgccatagttggatgcgatccccgtcctcgccaaccgacgttaaactgttggtatatgtaacctccaatcccccctaacctaagttttaccagtttctcggtatctgtaagaaccgagcgcacaccacaagtggcgacaagacttgtggaggtttgtacactaaagtacacgtctcttatagattttatctagagatctataaatagatgtaaaatattatctagacccccaccacccctgtgccatggtgcaactggcctatgagtcggattcccttttgatccgtcagcacccattctaaagactgttagcatggtcattagtctgtgaactctcgcgaaagcgttagtgttttctagcgatgcattgattgcgcgtggattccccatctggtgacagatgccccgcggcccaaaaggctagtgtgtcacaacacaccgtcaatgtgccagaaaccccatctggcaacactaattgttagtaccgattggtaaccactaatcgtccattctggctgaacattctttgggatgagcatagaagtgagtagaccccctagcgctaccttcgggcgtgactagggccagttgactataccgctccggtaataactggttaaaacaatgaaagcttactatgcgaactgccctacccaaggtagctgtacccacggctatcctgaacgtcggcagcctttcctttttattctttaaaatgttttatggtgacaatattgtgttatttagtttgttaattttgtttcttttgccttttaatttaactattgttaagcaaaacccccttgtctaattaaactgaaacc

SEQ ID NO: 2946 - DNA, 886 bp, Bidens pilosa tombusvirus
  strain pt033-tom-24, complete genome.2
tcgtcaacgggaagagtgctgccgaggttgaatcgggcattgcaaagcactgggaaatcttcggcttccaatgtgttgtcgaacccaccgtccataccctagaacatattgagttttgccagatgaagccggttttcgatggtaaatcctacgttatgacacgtaatccgcatatttgtctttccaaggatgcatatagtatcggtccatttaacacgacactcggggctaggaaatgggggaaagctgtcggtgaatgtggtttagcattgaccggtggtcttcccatcatgcagagtttttacggcatgttggtacgtaacgcgggtgatgttgggggaaaggtttcacgtgatgttgcatttgctagcggctttgcagcattggctaagatggggaaacgggtgaagagtgatgtcagtgaggaagctaggttttctttctacctcgcattcgacattagcccggatactcaattagccgtagaacgcatgtatgatgacatggttcttaacatggaattcgtcccccagggatcaccagccattgattcagacttaacatggattctcaaacacctcaaacagtaaaccgcggtaggtcaaaggaaagagctcagggtaaagatgatagcaagggatctttgaagaggcgtgttgccactgatgcgatcgcagccggggagggttctgctttgggcactatggtcatacaagctgaaacggtcactatgaccattaatttcaacttctagacatgcagtgtacctgtgtagtgcccagggatagcctcctcgacactctcaaagcttatattgtacttctcatagctttcattctcttcttcatcacaatcctttcagctcaccaaacacaatacataaata

SEQ ID NO: 2947 - DNA, 889 bp, Wenzhou picorna-like virus 15
  strain WZFSL85504 hypothetical1
acgggagcgagagctcccgtgctttgattgtctatacgtcgttcactgatactttgcgtgtgaaccacgtatcgttgaagtgttacttcttattggcgattaattacacaggatattaatcccgtgcattattggatctgtttagtctttacgacttcttttcgcaccagagagggcccacttacctctttggcaaacatttaggttggttttgtttacaagaccatattctaaatgaatactgctttgtttatcacactagaagaagaatccctcagattgctgttggattctactctagcataacttagcccccctccatgttttatgttttatgtcaccatgtcgaaggaggatgtacctcctgccggttgcgtaagaatgtaggctaccgaaactagtacatactaaactctcattccattaggggtgttagtatatgatttttaaaattgtctgtaaatagttatacccataaaaccaaataaaaattagtctagatcatttgtcaagtcagcaacttcttcactgagggtacagctatccctatatgggatgttgcgttaccgaaatcgaggagactggaggcgtcttattagagattaggagcccaccgcaacagctgattgattgaaatcttatttagagacccctgatgataactaatattaactgtattcgatgtcgcatgttttgcgtctagtagtaggttgtgataccttcaggttatagttattgtgccaggccacctgaatagacggattgattgaagcgccatgtgtagtgaacaccacaagcttgcatggtttgccgaggccacagtggagaggccaagcccacaacccgccgttatatgtgttatagaggtttttaaaatttagcaccaaaa

SEQ ID NO: 2948 - DNA, 890 bp, Macrophomina phaseolina fusagravirus 1
  complete genome.1
atggggaggaaaagagagatatagagttgtaccggccttcgggctggagggacactacatctctccggacctccaccttccagctgccggcctggggctggagagtgtattttgccgggcccccactgcctccggggagggggtgtaatcagtttcctcgggttgaaactataaaacgaggagggtgcgcccttgacagcgtgatggtgcatgggtacgcggcgtgattaaaactgagctatggtggttgtctagtcgtccaactgctgggtggatcgtcaaaagttcacgccccttctagacatcctaagtagtaggctacccgactcctctgtgagagggccgtgcaccaggtccgaagtggtcttccagaaggctttttgccgaggtaggtgaccggaccacaacgcctctattctctgttcctcctgcttcagggggagaagattaaatagaggcatccttcgcgccgcggattgctctgcgtgagcaaagcgcactgcgtcgcgggtagcttgcaactaccgaagccctagtgaagcaggtcctagggcaccttccgctaaagcctgtgagactaatggtagcaggggccttgcctatgaacctctacgctctcgggcggtatgtgacggtgagtgacctttgtggctggtggtcctttgcggctatgaacctctacaccttcgggtggtatgtgacgctgcgcacggggctattggcctgccaggtcgaatcctcctgtgtgatcacttgctccctgagtaagtgtgaagcgagtagggaaccagcatcgatggacgtaagctgggtgtggtgtggcttggtgccatgctgctaacgtagtctgcgtaggaggcctttatgcctatgaacctctacatcttcgg

SEQ ID NO: 2949 - DNA, 891 bp, Beihai picorna-like virus 45
  strain BHZC37433 hypothetical protein1
tgataggatttcctcacggaaatcctatcatatgctagattagcaaatttttgttattctggaagctcggaaaattctcattgtattagtgttctgggcaaatggactttgatcggtccataccagaacttaaattagtcatatgcggactaagctactactatgaaaatctacgcaaaattatttctgtagccctaacttcgggtgaataaatagaagtgttcgattgtcgaatcgaactaaaataaggcagacaacagataaaactgtttgtttaaaacttcagtcagcactgaaggatactcttatatttgagatcgaacatgctgatcaggttcttatattataaaacataaaaacattgggaaagttaattttgatcaacctctcgttcaagttaatgatcattatcacctctcgaaccccaatggcctgattttattttgtatatctgctctagcttgtggcagatcgtgtctacaacaagcttttatttctaaaaccatagaaaaagtataaaatgagccaaaaaaaaacacataaaaattttgtatattatgctcagaaagactctttttaatggaaatgattctagatgtgacgatggaaacctctcagctgtaaagtgctcagctcacgtttacctgacttaacatggtcaagatactgccgtagcccctcgatgggtagattcttttgagtcgcagatctatgatgtcatcggttcccatgccggtggataggccttgctagatgatttgaaattaacaagatatatccctaggtaaaagtcccaagggagagaatcagaactctaaatactgatatggcgtgacggacgcatgaataaaatatccaactacgaatcagatacgaccatcgaatttcacc

SEQ ID NO: 2950 - DNA, 896 bp, Bremia lactucae associated fusagravirus 2
  isolate DML-A_DN432391
cgagcgtacttcttccttagcagctgatgcttaacgacattaaactggtcggtatcagagatcgcgctaattagacggggtgtgtgcgttgggcatacagagtctagatgggggagagacatcaatgatggactcgaactcagccaggtcgtattgcaataaggacggttttgaaaggatctggcaaattcttttgagaatccgtgaagtcagtagaagggatgagtcaatgacgtaagcccgggccactggtttcaaatatatcaaaatctcatgtagctggctccggtcggtgcaaatcttggcggattgcttgaggtggaggtagagtagatgcggggactgtagtttcgtgacttgatcatggctcagtctgacagttaccgcggaaaattcagggctatgctcggatgctcttgctaacggctaacgccgtgcagtctagcacaagactgtgtcacagggatggccccacacatcggtaacttcatacgatgtgttaaactattacgtaaactcgtggtgcgatgtataagcattagaagcggggtgtggtgttaggaggaattctaacattgctaacgtatgctcaaccggcgaaagcagcgtttaagtagcgtatgggttgggtagaacgtgccttgatgcataagttatcaaggtggaacggccgggtaatagtattcagcgattaggcgcggggaacgaatggcctaccataactggtgtccgatagtgacgatattttatagatttaccgttgactatcgcagagaacagagaagtctggccgaatatttaatattctaatatctttctatagtagtagctgcgtttattttataaacgtgaaggccaagcatagttagacggtgacagtacattcctcaaacatc

SEQ ID NO: 2951 - DNA, 896 bp, Picornavirales sp.
  isolate H2_Rhizo_Litter_49_scaffold_571R
ctttgtcccgtccgtaatgacattaaactaagtctagctctcgactttaaattgagcaccaaatccacacgcaagtgtgaagagagaatgcatggacgtggagtaacccctaggactccatggatcgcgctctctagaaataggggttcgagcttgagcacgttgatcagctaaactcaagcctatcgtgaaattggatcgccgaaaatacatttgaaaacgaacccaaaactaccgtagacagtaatggactcgtagattttatcgaagagtctaaaactgtgcgtactgctgtcccgagattaccacgacctcgtgatatctcgccttgggcagatcaaacacctgtaaagatacttgaacgtgagtatgctttggatgatgttgtttatagcacttcttcaaattccgtgctgagatatttacctaatatttttgcacaaactgcctggaaaaacgcaatgtcttcgtttcgttatataaggtgggattttcttgaatggcgttatcaaataatgtcagttcctcaggtttggggtgctgtaggatttacatgcattccaatggacccgcgtcgtcgcactgtactatcagaagattatggtttgctatctcatactgattgccaaattgccgatttttccactgctaacagcggaagaataatggttccttggtgctctttgaataagtggcttgactggtcttctcgtcaagaggagggcttcgacgctcaaaccttcaatgagctgaagattgttggtggaccttggatatattcagccgattcctcaatcccgactagtgttaccataaatttgtggtgtagcttgcatggagtgcaagtagcaggacctcgtgtccctaatactgtgacggatgaaggagaagctcag

SEQ ID NO: 2952 - DNA, 901 bp, Beihai picorna-like virus 39
  strain BHSC164089 hypothetical protein1
cccatggcaagttatggtctgaagctagataagcctctcgagaccggtgtgtacaagtactgtgctcttttacctattacgatatcactagaatttcgtgttttaaagagcacgatcacactagattatcgttttcgatatttagagattttactttgcacatttgttgtgttaaatcaaacctgcatctttctttttagatgcaagctcgtcattgactttgagctagttggcaacaaattgtcaccaacgaatcaaaacgacggtataccctgtggtgacacacaggggaatccgtgcctcatttgaggaattagtcaatgtaagatagttccattaactattaaaattctcccactgggagtgtcagcagaacgactggttctgccacgcttgtttactgtcaatccgaaagcgtaatagtcggatagaatatcccattgaaatgggcggtatgaggaccaagacttcgtgttttgagcctcgctctccgatatgagccaagctatcttttaaaatagcccaattgacatcaatttacttactccacttgtggagagtccccctattatgatttttaggctgggcatgtagttgatggcttttgtcacgggccacattgtatggatacatccaggacgaaacgttctggacatgagaatcatcacacatcccgggcagtcttttgactgtttaccattgggatgtgtgggtgcaagcatgctttgtggtaggctgagggcgtctcatctagaccatgagacagcgccctatgaagcctgcggtagctggatttaatcaccagtgatggtacgtggcaccctgcagcagcagtttccaatacccggtctattccggatattggtagtgttgtgcaggaccccgggcgatctatatcaaa

SEQ ID NO: 2953 - DNA, 911 bp, Beihai picorna-like virus 13
  strain BHZC37435 hypothetical protein1
ctgcatgggcgttccccatgcagacttttgcatttagttgtgagttttctaactcaccaaatatcgagcgtaaatcgctccttacaactcagttagagatatgtggattggagcgtacatcgctcctctatcactgtttcaactaagttcttacaggcgtacatcggttgtatgtatctttttaatagcttagttgtatgatttgtatatctacagaagttctgcaagattctttattaacgcaatatcttgtaaccaggatttgatcacctgaaattttagtaatgaattgtttgaattatgtgatcgataattagattcattacggtgcattaagataccaatatgatatagctcctattaagttagttagagcgtcattttggtggattttttgtgccagctccttttaattattaacttcgaaataacgtaaagtgactacgagcattcttggactcacaaggtaataagagactcgaaccccgaagcgcgaggaggcacacgcattctctattctcgaaaggaatggaggcaatatatgttctgaagttattggttagatagcccgaggcacacgactagagatggttactataggaagtaattgtatagaaaatttgttgatatgagaattgttctaacatccatctcgcttactgctgtgtagtagcaagctgtctatctagactaaaactatattgttctgctaaacggattgacacccggccgacaccttagttaatgcaaaacgtaggtaattgaaatgattcggtgaacattttaagttgagcaaagttctgatgtgcgttatagaacatatcaaaatcacgcacagaccctgttatagatcagtaaaactagacctcttcatgttatttgatcacatcatgaagattctttgatcagcc

SEQ ID NO: 2954 - DNA, 913 bp, Wenzhou bivalvia virus 1
  strain beimix75829 hypothetical protein1
ttgatgcgaattagctattgacagtttcgatcttgtaacgatttcttttgagaattttgttagagatctagatttcaattaagtgccagttgtggcgattttaattgtgatcgactccaacgtctcagttttatagatccagttgtggatgagacttgtatataaatgtcttacactttccatgtatgtttattttgtcttttgttcatagtttccgttgtaccagttgtggaggaaatttgacgataaagatttatgtgtgcgtgttctattgtcttatatatataggttcattcatacttgtttgctaccattttagtttcatgcaattgtaccatatcattcacgaaacttcatgttaggaactttcaacttagttttgattagcacgttaatgttttgaaagcgttgagcaattgaggttgttgggatcgcgtaaagcggctctacgttgttactctttccgtagagattttgttatgttccgaccctagttaagctttttggtggttcttaaagccggttaggttaggccctgcaaagaagcttcatatctgaaacgcccttactttgattctcgaaggcgcgcaagctaccggatgatgataagtaacatgttggcaatgtatttgtacattgtagggagatcactgaagcactcaggcattctgcatagctgtcggaatggcctgttacccgtatcagcgaaggtttgacgtattaattaacctcttttcgtgcaaaagattctattttgatatcaacccggtgaagatgcttaatccactgttccttttaggggagcaacattttgcgttcgatccaccccttatttgtgcgttgatctatcagtatgatctcgtagtgatgcgcgtatttaaggtttttccaccccaggtggcttattttaacc

SEQ ID NO: 2955 - DNA, 933 bp, Beihai picorna-like virus 116
  strain YYSZX16386 hypothetical1
tgtgggtacaaacccacatacatctgtcgtagatcgcgacgtaaaataagcgatcattcgtagctcacgaatttaaataagcgagcagtcgtagatcgcgactctaaataagcgatccggagttgatatgcttacgtgacaaaaatatattcatcttttcatgatgtaaactgaatttgtgttttataacacacttctataactcttttacttattttatatttacttgagtttcccctcattttctatgaggatctaacctgtatttataccgtctagaattttataagtacgggccattgcctattttctgaaggtatacgtttacgcctatagccctatagtattcgtgtatctttctttcctttcttaatagcactttgcttagtaagagtctatctctcttagctactcctgctataaagaggatgtcgttgtcacgactttaaatgaaagacagacctgtgtgaagacacaataaaatacttccttatatatcgttttagtatttgaaatgttgttcttaggtagtagtacgttcggaggtgtgaaaacctctttcgcggaacctactggtatgagcttcaggacattgaacgaattatatatatgagagttggtagactactctactcgtcagactcatgacgttaattatgatagctagcttgacatctagtgaatgattttctgtataaagatattgtttcattgtgctaagtactcaggtaagctgtacagcaatgtatagtttcagagagctgtttcacaaccagttcttttgtgagtatgtcgagagtaaatcttagtgcgcctacgtggacaataatcttgtgatgaaggattttcattttatggtcggaaggtatccatatgacttccctctattgatgttccccgttcgattggattaatcaactaccatttctttat

SEQ ID NO: 2956 - DNA, 934 bp, Hubei picorna-like virus 29
  strain arthropodmix14031 hypothetical1
cacggggggaacccccgtgcgtccttttcttctatagacactttgttgtttgctttgaactaacttctgcaagtgtattttgaatttcgatttgaagtgattcattgagatttcattagtgctttgctggagtttttcgagaattgtgagtttgtgttggattgtttagtgtctctagaagagaaggtaactttttcataacataggttaattatgaatgaatgtgtgtatgtttggttgtgaattgaaagctcagctctgcacacaattgttattcttgtgttatgagttttgtttcagtttgcttgaaaccagttattttgaaagcagttatgttagtaagtatcctcctcccagaaggagcctggtgaaagcaaccgctaattgtaagtaaagtaactagtttagtaaattaatgttcgttttattatgtgcttcgaatgttttttagtaaagaaagcatatacctcatgtacttgacatgtacttgttgtatgtatctttaagatacaattgtcccatagatctgttgttctctagtagttgagaccttatcagtatgagcagagcgtagcctatacctcaaaacacacactgtatctgtttggagcagtggaaagaagttagggttttgcagagtgatatgatctgcaatgtcagctagccggcaggtgttctgtatgctagtgattacgcgtagtcctaaaccgctgataagctttccgaacgatgaactaagactgtgaagaatctgtgggttgaccgaccatggattgtaaagattgctatggtacgcccaggcatgaggttggccagttcggggtcgctccgttcatttccttaattacgataattacgatttttgttttgttgtttccttgtactgtctctaatcttgatatttttgaatttattgtaatttaatttttattgt

SEQ ID NO: 2957 - DNA, 940 bp, Citrus tatter leaf virus
  complete genome.1
aaatttaacagcgcttaatttccgcgcattacgtcaatggctttcacttacagaaaccctctagaaattgcaattaacaaacttccaagtaagcaatctgatcaattgctttctttgaccaccgacgagattgaaaagaccttggaagtgacaaatcgcttcttttctttttcaatcactccagaagatcaagaactgttgaccaaacatggtttgacacttgcaccaattggatttaaatcacactcccatccagtatccaaaatgattgaaaaccatcttctgtatatatgtattcctagtcttctatcttctttcagatcagttgccttcttttctttaagagaaagtaaggtcaatagttttattaagatgcattcagtcttctcacatggaaaaatcaagtctttagggatgtataatgcaatcatcgatggaaaggacaaatataggtatggtgaggtctctttcacttctttcagagacagagtgattggtttgagagaccaatgcttgacgcgtaataaatttccgaaagtccttttcatccatgacgagttacactttttaagcccttttgatatggccttttttatttgagactataccagagattgacagagttgtagctacaactgtctttccaattgaactactttttggtgataaggtttcaaaagaacccagggtttacacttacaaggttcatggtccccctttctccttttaccctgatggtgttgcctctgaatgctatgagcaaaatctcgctaactcaaaatggccttttacctgtagtggtatccaatgggccaacaggaagatcagagttaccaaattacagagcctttttgctcaccacgttttttcatttgacagaggaagggcttgcaatgaattcaatcacttcaataagccgagttgcctacttgcagaagag

SEQ ID NO: 2958 - DNA, 957 bp, Rhizophagus sp.
  HR1 mitovirus-like ssRNA putative RNA-dependent RNA1
tcggcaagggctcgggaaggtgccgaccttcctcagagtcctgatcagactctggaacaatctacagactactctgttgttaaacactgtacgtagtggatatcggcaagggctaatttatagatctgatcaatctatatctaatagtaacagcttattcttaagactgatcatcttaagtagaaagctttctcataatttcactctctactaaccttcaaattgttctcataatcttaaagcgctatatctaactcttcttcattaataacattaccaactatggttaaatagtaaagtatacactatgcttgacactaatccaaccttaatgtacagtaaggccattagtgatgtggacttcactcagtttctcttacattccttccaatactaaatcggatacttgttactctatgataagagttgtcttggtcacggctactagcagctgagtggcgaaatcctctcagggcgtgtacacccaccaaggttaagcaattctaggattagggagcctaacaggttcaaattcgatggacaatctggaaaatagggagacgatccaacatctaacgctaccgcggcacaggttcttctgtggaaggtttgcagtcacctaccacggtttgtcaccggtctctctaataaactctccccccttcaatttaccattttcccttccattggtatctttgtaacctatcgcagacactgtgtgggtagagcctcaaaaactgaagcacagatgataggtaagtttaacctagcactttacaataactaggccgtgcttatgcatgcaaatctttatccttccactcctcttcgtgcaagcatggctgacgcaacgagtgatgtaacacttatgcttgaatcagcttaatagattcttgtatctaggtttctagattttattggacttcttatgattagtaaacatacgcctaaagtgct

SEQ ID NO: 2959 - DNA, 969 bp, Ebolavirus
  Mutant Zaire ebolavirus, isolate Ebola7
taaggctgactaaaacactatataaccttctacttgatcacaatactccgtatacctatcatcatatatttaatcaagacgatatcctttaaaacttattcagtactataatcactctcgtttcaaattaataagatgtgcatgattgccctaatatatgaagaggtatgatacaaccctaacagtgatcaaagaaaatcataatctcgtatcgctcgtaatataacctgccaagcatacctcttgcacaaagtgattcttgtacacaaataatgttttactctacaggaggtagcaacgatccatcccatcaaaaaataagtatttcatgacttactaatgatctcttaaaatattaagaaaaactgacggaacataaattctttatgcttcaagctgtggaggaggtgtttggtattggctattgttatattacaatcaataacaagcttgtaaaaatattgttcttgtttcaagaggtagattgtgaccggaaatgctaaactaatgatgaagattaatgcggaggtctgataagaataaaccttattattcagattaggccccaagaggcattcttcatctccttttagcaaagtactatttcagggtagtccaattagtggcacgtcttttagctgtatatcagtcgcccctgagatacgccacaaaagtgtctctaagctaaattggtctgtacacatcccatacattgtattaggggcaataatatctaattgaacttagccgtttaaaatttagtgcataaatctgggctaacaccaccaggtcaactccattggctgaaaagaagcttacctacaacgaacatcactttgagcgccctcacaattaaaaaataggaacgtcgttccaacaatcgagcgcaaggtttcaaggttgaactgagagtgtctagacaacaaaatattgatactccagacaccaagcaagacctgagaaaaaacc

SEQ ID NO: 2960 - DNA, 975 bp, Subterranean clover mottle virus
  complete genome.1
acaggcatggggacctagtgtacatagcagtagcggaaagaatatgtatgttggctgaggctgatcttgcagatgctccagatccagtggaccttgtgaaagctggatactgtgatccgataagattatttgtcaaacaggagccccacccactcaagaaggttgtggaagggagattccgtttgatttcttcagtatcactagttgatcaactagttgagagactgctcttcggcccacaaaacgaaaccgaaatcgatctctggcaatcagtcccgtccaaacccggaatggggctgtcgcaaccgtggcaggtgtccgctctgtggaatgacttagagcataagcataagctcagtcctgcagcagaggcagacatctccggctttgattggtcagtccaatcatgggagatcttagctgatgtgtgcattaggatagatagagggggttttaaaggtaacctccgtaaagccgccctgaataggttcaaatgtttctccaatgctgttttccaactcagcgacggaacattgataagtcaaggcttaccgggtctgatgaaatctggaagttattgtacctcgagtaccaacagccggataagatgtctaatggctaaaatcattggagccccgtggtgcattgccatgggcgacgactcggtagaaggatatgttgagggcgccagggagatgtacgactctctcggccacacttgcaaggattatataccttgcaaagctgatctagacaagttagaggaagtgaatttttgctcccacactataaggaaagacagctactacctccaatcctgggcgaaaaccttgtttcgattcctcagtcaacctgaagatgtcaatgaacttgctgtggaattgaaaggatgtcctgaatggccccggatatccaagtacctccgtcggattggaaagatctccgacaaaacttcagaaggagagggaaaacaaa

SEQ ID NO: 2961 - DNA, 988 bp, Nilaparvata lugens honeydew virus-2
  genomic RNA, complete genome,1
attgaaagagcggcggcgcgtgtttttcacgcgtcgtcgtcttattcgggttgcccaagtgcctgctacattgtttatttgtaaattctttaccaggcctactctcgaagtacactgctaaagttttgcatctcgccttgtacctcgtcttggttttcttgagtagatttcgattgttgtgttttacatagttgccgtctctttcataccctttattggaacttattttataatttatattattattatacattatctggttataaatgttaatattctttgtgaagggccgcattacactaatttagtgttgattcaattatatttttgctttgttacattatttatcgtgagggaagtagtccatgatagtttaatgtgatttggccggggtatttattgaattaggaatcttttacagcaatatgtgtgatagcgtcaaaattttgtttattgttctcattctaaattatgtttatatctttagagcgatgattctatcatattgtaatgtaatttgtgttagagcctgctgagtttcttttcggacattcccaagaagaaagatcaactcagtaggatagcttttagtagccagtacatacttatttagtcactgtgcgtatggtgaagaagcctctacaagatttcagatgtgtataactggtgctagtcattttccgccagcctgtcttaacttagcgattaacctctttatataccaagcgctgattctgtattttagtagtgtattttatttaattggttgggcttagttataagctaggatattcaattgtctatctagatattttcttttatctcaaacggatatgatatcaaattgatgattttccaatttaccgtcatatcgtctgtgtgtgatctatatcccagtgtccttattcatccagtctaaggaaggtaagatatacgtagaaattattttaactgacaattgtctagagttggaaattttattttaaaa

SEQ ID NO: 2962 - DNA, 991 bp, Yili teratoscincus roborowskii picornavirus 1
  strain LPWC1754991
ccggggggaatccccggtaatccacttttcggccagcgtctgttgctggcactctcgcccaatcttataacactaggtattgggtcttacccgaaaggagaatcccactacaatagattataatgataaagagatagatcgacggttgcgggtcttaccttaaccgggaatcccaaaacaagcgtctatactccagagagagatcaaataagcagcgtaatggtgatacgttaaacaatccgtcatgagaagacgtaaaaatccttgtactgcaagtaaaattgcaacttttgtaattaagtaaatatgtacctcacacatgtgagcactctctaacatcagagaggaaataatcttaaattgtaatacgtgttctggtgaaccgtttagaaaccacgtccgactagagagactagtccacggagaaatccagatgttcaagttcactacgctttcctgcggaaacaatggttagctgagatttgaacgggcgtttaagttctagacacctcacagtggagcgatccacaacagagctacaatcttcagggctaactctggtgcgccgaggcatagcggcaactgtgtattaggagcatttcagggcttgaagagcaggcacgtgcttaaaatgtagcaaaactcaagatgttgagcaatgcgttctgtttgaaaaccatgagtacatggtaacctaccacattgacctatagtgcataacgagtgaagatgtagtttgaaaacatgcagcggatcatggaattgatcgcggtgtttcagatgaaattttcattgcagtgaacattatagagggctcgtttttcgataaccctttgtcagataatgttggaggtgggtacacccacttacagaaggtaccgttttcgtgtgggttgcgaaaatggcgttattagttaacacctaataatgttgtgcagggtgacagcctgtcggcgggtgcacatcttgttttaatccgttgtcttgccat

SEQ ID NO: 2963 - DNA, 1000 bp, Agaricus bisporus virus 6
  isolate AbV6-003 segment RNA2, partial1
attctaggaattgatgttctttcaaacaagatttcgattggatcattcaaacattgattgtttgtttgttaagcttgcgcccatcatgttcgcgtttgactgttaattcttttccctggcaacttgacgtcttgtcacccggttacgtatttatggcttgccttgctagggcgcgtccgcctataaacgacttaagcttcggtctagatttgctgaaagtagccctttcaccatcactctgccgtgcgtagtgagttttgtagaacattgagtgtttgagcccgtactcatcacgtgcagtcttttcaactatgctaccttgagttgtaactcttgatgctctattggaggctgtatctcgaaggctatatacctctgtatcctgggtgaaagtacccgtccctcggagcatgtactaatttccttgtgtaagatgttgctcgatcaactctacttggagagtagctttcattaacctcttggagaagaacaatgtttatacccattctttgacgttcgatgtcgatgacacaccaactctggtgagtttgatactgttgaactcgtgagtacgtctttgatgtttccccctcagaaagttgcttcaagttggttccggttccgcttgccttttcaaatcatctttgggtagacactggtgtctgtaaattcaaactggtggtaagatccggtttcccaaatctctgtctattggaggtaacgattcatgcggtgacactattagttttgacctatacccgtttgtaacgtttcgatgtccaagacacaccaactctggtgaactgaatcccacatttggttcgtgagtgcgttgcagatatctcttgtcaaacttggttgttcatggcaattttcacatggtaagattgtgagaagacccctgactcaacagtagttaattgcgccgcggttccgtattttcatctaatttaccctactttcatgatgttgaggagtaaacctcctcttttcgtttata

SEQ ID NO: 2964 - DNA, 1000 bp, Trichoderma atroviride mycovirus
  strain NFCF377 structural/gag1
gtacagatccgatgataaattccggtgatgtttaatatagcgagtttagtctcaaagctcgtcctgcggatatacaccagctcaagggggtatggactgcccttgtaaagtctacaattctagaggagaaggtgtaatttgctaacctccttagataaactgcctcatttatacatcctgtgctcaccataagctaggatggcgcttggtattaaattgagcgcaatacctccctcgaggaaagccgggggcccatcaatggggatatgaaactaggccctggtagcaatctcaccagtaagatgattttagctctaatgtataggcccggacattagtaagattacagggcaagaactatcctagtgggtctgttctcgtcgttgcgtttaacgccggcattcaggtccaggtgcgaggtaactgagattttcgactcaggtgtgatccggtggtgtcggctaccccggtgagctatcgtaacatcctacgccgttagcctcctatctagcctctagtaattatttccactgctatgctaatccaggagtgagtagggatgggaacgagcctttcgatggaataagtccctaaatagagtggcatcctacaaagaaaggtggacagactgacactcgacacagagcaaggtgaatcctgctcctagcaaacagtcggttggggaaataagagtacccaatgatggttcatcccttcaccgggtggtatagaacggcgcgtgaggtaatacatagtattatccacctcacgtatacctacccacttgaagtagggttgttggacgtcccttgaccaacttatatataccgggctgcgcaaagcctttgtcacccatttgtctaatcaagatgccagtatcgcctaccacatcctcatccccattaattttggacgaaagaagccggtagatagttgctatccaagatacactgattagagatctgaaagtaccgagtcataaatttgctgcacgaacaaa

SEQ ID NO: 2965 - DNA, 1000 bp, Tomato mottle mosaic virus
  isolate CpB1, complete genome.1
caagtcactattgggcaattgtctgattttgactttgtggatctgcctgcagttgatcagtatagacatatgattaaagcacagccgaaacagaagttggatacttccattcaaacggaatatccggctctgcagacgattgtgtatcattctaagaagatcaatgcaatttttggaccgctcttcagcgaactgacaaggcaactactggacagtgttgactcaagcagatttttgttcttcacgagaaagacaccagctcaaatcgaagatttcttcggagatctagatagtcatgtccccatggatgtgttggagttggatatttccaaatacgacaaatctcagaatgagtttcactgcgcagtagagtatgaaatctggagaagactgggtctagaagattttctggcagaagtgtggaaacaagggcataggaaaaccactcttaaagattacacagctggtataaaaacatgtttatggtaccagagaaagagtggtgatgttacaactttcataggaaatactgtcattatcgccgcgtgcctagcctcaatgttaccgatggaaaaactgattaaaggggcgttttgtggtgatgacagtctgctgtacttcccaaagggctgtgagttccctgatatacaacaggctgcaaacttaatgtggaactttgaagctaagttgtacaagaaaaagtacgggtacttctgtggaaggtacgtgatacatcatgatagaggttgtatagtatattatgatcctcttaagttgatttcaaaactcggtgcaaaacacatcaaggattgggatcatctagaagagttcagaagatccctctgtgatgttgctggctcgttgaacaattgtgcgtattacatgcaattggacgacgctgttggggaggttcataaaaccgccccccctggttcgtttgtttataaaagtttagttaaatatctgtcagataaggttttgtttagaagtttgtttatca

SEQ ID NO: 2966 - DNA, 1000 bp, Cucumber mosaic virus
  isolate Kirinyaga1 3a protein gene, complete1R
aacagaacattggaagaaaccccacaacaacatctttgtccgactctagtacccacttcaatctttctttttatctttcaaaggtcctttgggtatcttgctcaaaaccttcgcatcgaacactgcatattgcttcttaatctcggcaatcgccttttcaccaaaagagtccacttgatcttcatatttctcatagagcacaggcacagtatgaagcaaaacaaaagctatgtagaacaacgtcaagaagttcgcccagctccccagaatagagaaaacccataatccagcaatcactgataagaacttcttgagatcccttccggatgcaatatcccttaacactgaaaatgcccgattaatctcaattctaagagcagaggcaaattgtaaaatagggtcctctggaatgtgcacttgtgggatctttggcggcctcttgttgatgaaagtggatgcattggaccacaagaacaaacccgcgagggcaagtattacgaagtggcaaaccagagtgaggaggtggtactcaagcaattcaaacagaatccatatgactgtagcaactccgagtgtcgatgctgatatcttcttatttctccacagaaaaacatcagcctgttttccgccaccaagaacatggtgaatgggcttttcccttccgaaaagcctgaaaacctttgacttcaaggaatcagagggcccggttttctcgttgtcggaatccgaggaagacgatgaatcgtggtcgtggatcttcccggaaatcttgtccaacaaggactcacccttggcctcctcgtgctcgtggtgctccgccatcacagaatcgccgatcaatggaagcgtctagaaggaataagaaactccctttttcaccaagagagagagtatgtgtgtgtgcgtgtgtgtgtgtgtcgcgtcgtgtcgagtcgtgttgtccacacatttgagtcgtgctgtccgcaccttcttttcagtgtgttagaatacccgaggc

SEQ ID NO: 2967 - DNA, 1000 bp, Strepsipteran arli-related virus
  OKIAV104 cRNA sequence.2
actcatagtaggccaacaatatacttgtcgattctactagcgtcctgtatcaagacaccatcggttgagtaagattatgtctaaccattataaaataatagcagatattggtttgttggaactagacactggaataactagaagagtcaaggctggattagggacaatatccatctcaaatgataaacttcctaaagttagagaaattctagccaatcttatattactatatcaggtacaagagttagagcactggtatcttcgtctagatttccactctcccagtatgaaaaccctaattgatatgtattcagcagagttattatctcaagagcaagtttggtatatgagaattagaaccctgctaggatctggaagtgcatgtttggttaaaagtggctttgaagtgccgactatgcaaattatattagtgaaatatgtttacccatcggcattcatacctgaatagattcttttaaacagggaactttatttataacactttcttttctttacgcaaatttatcaatatacttgcatatctagcagtctcaactggaagtctctttaatttatttatcaatacacaagccagcttatctatatgattatattatgtatcaaatgcatgcgttcttagaacattaattaataaaatatgtctgctatacacaggtgataaccaatgagattatagagtaccattacaaaattgtgtctttattggcaataactagatgcttatctttctgctttaatttacacttagaaaaactcaagaagtgccatctaatagctacaatataaacataagcgcgaatacaaccaatataaatcgtcaccaaaggcttatgcgccagacatctcaaaaagaactcttgccagaggaatcagaagctataaataaagaagcatcagcattgcgagaacagaaatcaattgaccagaatatataattgaaattcaaagtgaataaatcttgcttaacataatctccagt

SEQ ID NO: 2968 - DNA, 1000 bp, Beihai rhabdo-like virus 4
  strain BHJP58499 putative nucleoprotein,2
atgcttgaatcttgagggaactcacatcgacatctcataactatgatattgattgctctggttttgattttatactttgatgttgagatatgcggggggaaacaggccagagtgctctttatagaaaactgaatttttaatcatgcatggaagggaaactgcccgatcctccgggaggttagtgctataggatttctagagcagatcagtagaattagtgttataactttggcttcttgatgtatgttattattcttgttatattacctgtgtactctatatcatactttactctattaaatccagctatccattcctgtaatgtatgcctaaatgtaaccttatagtgctataaaaaaagtaacattacccaacaaaactcggaatcctctttaacaatgaatagtgattttactgatataagctcagaatatagcgactctgctaaaggagacaaacaaactcaatctaagcaactgattaagaaaataaggagaaagttaaagacaagaaagaacactaaacagaaaaaaacctgtgccagaagggacagactcatcagatcaggaaattcacccctatcagctattatacgacagagaaaagagactaattgagaaggagtcaattgagaaacgcgtcttgaagaggaaatctgccccaccgcctgagcctcctcaaatagaaggtgatttatcggacgagttgcacctcttgatagacgatcaatcctccaagagagcttgcaggccgacagaaatacctacggacataaacagccatatcgtgacagctctgcacggcctcggagagcagatcgggaagctatccaagaaggtggatgagatcttggtgaatcagcgcgatcagtggtcagcaattagaggactgcaggctcaggtggctaagctgaacggagaagccgtagagggtctgctgtctccccaacaggaacttcggctagagtcattcaacacgaggaaggctgctaggaccatcg

SEQ ID NO: 2969 - DNA, 1000 bp, Feline morbillivirus
  strain 761U, complete genome.1
tcctaaattacttgttaagccgccacctagggtaaaaacaagcgttgatcacagtaatccattaaaaggggccacaggagggaaattagcctcacctgggatggagactacattattcgagaggagtggtgcaaccccatctgtacacccatatactcaacctgcaagcgacttcaatgtaggtgcaagcaatgtccatcaacctgccctaaatgtgaataataattgcaatgatggtagggtaacagcgcctaactcacataaagatatcgagggtgagtctgaaatatctattcaagatatatataacttgattcttggatttaaggatgattacaggaaattatcaaacaaattagatatggtattagagatgaaacaagacattgacaatctaaaaaagaatagtgctaaagtgcaattggctctatcaactattgagggacatctatccagtgttatgattgccatccctggttcaggtattgattccacaggggatgaggaaaaggatcagataaattctgacttaaaaccactgctaggaagggatcattgtagagcatttcgagaagttaccaatcctctagatgagtcttcactagccaattctccaacaaaacatgttgccaaggtaaacaaaaactgcactcttcagaagatcaacaagaacgaaacatctgcaatcaaatttgttcctagtgacagtcatgcaagcacatcaaccatcagatcaattatcaggtcatctaatctcgatcaggatttgaaaacaaaattgctcacaattctatcccagattagaggggcagacaatattagagaattctatgaaaaggttatgatattaataaagaataagaattaaatattacaaatctacattcattataggttgtaattgtcttcaataagatttggtcagtttcatatatatggttattgatttgtgataattataaaaaacttaggagctaaaggttactcagtcatatacagc

SEQ ID NO: 2970 - DNA, 1000 bp, Peste-des-petits-ruminants virus
  complete genome.1
gggtcccggaaatacccgatgtcaagaactctagaccatcagcccaatcaattaaaaagggcacagacgggaactcagtcttatctggaacggtgacagagtgttcatcgataagtggtgcaacccaagctgtgccagagtccagatgggagtcatcagagcgaaatgcgtctgtggggagtgtccccaaatctgcgaggagtgcaaagacgatccaggggttgacacaagaatctggtaccatagcatcactgactcagcctaaagagaatgactccgagtttgagtatgaggatgatctattcacagagatgcaggagattcgtgcaagcattgctaagatccatgatgacaacaaaactatcctctcaaaacttgattctctactgttattgaaaggagaaatcgatactatcaagaaacaaatcagcaaacaaaatataagtatatctaccattgagggccatctatccagtataatgatagccatcccgggctttgggaaggacatcaaggacccaacatctgaggttgagttgaacccggatttgagacctataatcagccgtgattctggcagggctcttgcggaggtcctcaagaaacccgctgttgataggtctcagaaaagcggaatcaaagtcaactccggttcaaagggtcagctccttaaggatctccagctaaaacctgtcgacaaacaggcaagctctgcaatcgagtttgttccatctgaccatgaatcatccaggagtgtcatccgctccataatcaagtcgagcaagcttaacattgatcacaaggactatcttctagatttactgaatgatgtgaaaggctccaaggatcttaaggaattccacaagatgctaacagccattcttgccaagcagccgtaacacatcctataatcaacatctcatactcggttgaaaacatcctctcaatcaggctattacaaaaaacttaggagcaagggcaactgagcttcacagacaag

SEQ ID NO: 2971 - DNA, 1000 bp, Scaphoideus titanus bunya-like virus 1
  isolate St_USA segment L,1
ggtttgacaaatgtacttgactgaccagcaggtatgaccgatgtatttggttttaaacaggtaggtatgtcaggtgtatttgattgacgggtaggtatgccaggtgtaacggggagtctattttaacaatgaggtggttgctttggctgactgatttttagtaaacgtgcttcctctgaatgtggataagactcaaataatacattttaaagcaaattacacaaacagttttcagcaaatcagacttctaaattctcggctggtccctgaagatatttgttgaaaataaaaatctgtttcctcacatttataaattgggtaaaaaactaagttcaccaatctttttccttagaattatcactaaagtcacaaagacccaattggatatctatcatccttatttttaatccctgttgaattagggaatttttgtatgggaaaattcaagccactccataagttcttaaaacatcagaaaaaaatcaatgtgtactatagccaactatacttacaatattcatgacaatatatttttcagcagtttcaagttttcatattttatgacaactacattttaaaatagcttattgggtaaagaataactggttcacattcagagaatgccaatcaaatgtgtctatgccactagatataagcataagattaagcctgtaaatcataggctaagcctgtaaatcatgggctaagcctgtatcagtgatcagtatactagaccacaaatatataacgttccaacaaatttaaaaatatcaccataagttttagattttggaaaaactaaagaatggcttttaacaaaaacattttattctctagaagaataatttaaaggaaacgggaaaacttgaattcattaatagattaatttttctcttcattagtactgtaatttgacaaaagtgttctgtcattgtttaagggcagataggtacgactcaagcacgctgaggttaaacacaaatgagtaatctaaagaaaa

SEQ ID NO: 2972 - DNA, 1000 bp, Astrovirus sp.
  SG, complete genome.1
ctaaagataagtaaaattgaggaagaagacattaggcaaattgtttgtgctgatcccattttttctagaattggttgtgtatttgaagagtaccaaaatcaattgatgaaaaatagaaccctgacacgtatgggtcaatgtggatggtcgccgtttatgggaggtttccataaacgcataaagcgcttagttgataaaggcaatgattatttcattgaattcgactggacgcgttatgatggtaccatccctaatgaagtctttagggtcattaaggactttagattctcgtgtcttaggggggatttgcaaacaaaggaaaatagagatgtctataattggtattgtgagaatatatttagaagatatgtgatgttaccttcaggagaagttacaatccaggacagggggaatccctctgggcaaatatccacaactatggataataacatttgtaatgtctttttccaggcatttgagtttgcatatctgaatactgaattggattctgatgaattaaaggaaaattgggataagtatgattcacttatatatggagatgacaggctaactacaacccctattttatgtgataattatgtagacagagttattaaaatgtatgctgatgtctttgggatgtgggtcaagagagagaaagtaaaagtttcaaataaaattaatggattgaccttttgtggctttactgttcaagagtcaaatggcctttttgtccccataccaactgatacagataaattacttgctggtttaataacaccaataaagaaattgcctgatattttgtcactctatgggaagctcctttgctaccgcatccttggccataacttgccggatgaccataaatttaaaaattatattttggtcgccttggaggtagtggccaggcacatccgtgctagtggtggggaagaaccctactatatcacggatagcatgctggataggctttggaggggaggtccaaagcaaagtc

SEQ ID NO: 2973 - DNA, 1000 bp, Darwin bee virus 3
  isolate NT-12 polyprotein gene, complete cds.1
gccgcttatgttaagtcagaacggttatggatcttgagcatttactttataggtttaggcccgaagcgaagggtggcgtaatgatcaccgccgtgaaagccagtcgtgggggtacctctatggagtacgtgttccttctaatctgggtatggttttgattaaccagtacacttatgaatgagcaccttgaatgaatgtagagtgaatgtttgtatactatttagtgaagctgtaatttggaagtagtacggaagtagtacggaaaccgaagcctgaagccgaattacagaagtagtagcttagtgtgtgtatacaaaacagtagacatctgtggcttgtctagaagctgagtatcttctttaaatattactcaattctgcgtgttatattatctattatattagtaatattagtagtgcgtaactaagtacctcctctttgagtttgagtctacttagaccactgcagtatcgagtagtaatctttaagaatagtgcaatatgttgatcgattgtcaaccaccgttaagggtaacccttagcctgtggtaaaccaatgcatgcgaaggtctagcaaactggaacatgtgagttggtattccctatacagtgtgccaccccagagagcgggtatagggcatgtcatgtcaacatatgaattttctaaaggatgtgctgcgatgaggtagggacccctctatcctctaggtactgtatgtcgcgaaagtatgaaagtataagaacgtaatataatattcagacgtacaatggtatactttaagcaagtaatactggtgtgttgtacgttaaatttgcttcggtatcactctcacaccacagccgttagtgtctcacagtggagtagggaatctttatttatttatttattgctgattccattgctgattatactgctgcgctcttgctaatttatttgctgatctatttatttatttattgctatttattgctgattatttattgctaataaatcatataca

SEQ ID NO: 2974 - DNA, 1000 bp, Picornavirales sp.
  isolate RtNn-PicoV/HuB2015-2 polyprotein gene,1
ttagttcagtggaaagcacaacaccgcttcccccgattatgtgacatcaagtaagtgggcggatgggagcccctcagaatccccgtctcccttgacgggtttgacttttaaaattcccataccggacgaaggcgcttgcaacaagtcaggtttattttctagaattcttgtttttcttaaccctacgtgatctatgcgtagtgggcggtttagtgaggaaccgttctcaggtgatccccgcacgcttgtgcggaactttggacaccacctcaggtcaggtgagacgaaggtagtgtatcctttctggaaatcttgtaatgaaaccctaacagttcatcctcttggtataagctgttcccacggctgaaacttgaggctctgatttgcacggaggctgtggacgaacatctggtaacagatgccacagtggccaaaagccaagtgagcaagaaagtccccttaataggctgtacccacggctgaagactgggatggactgcgttcaccacgtgtatccactttaagtggctgtttggttagtaagagcttgatggaaggtttggacgactgctataagtccacttgattggtttgtgtaggaatgctgggcaggtacccctatctagggatctgagctcaggctaattgtctaagcaaacccaaacttcttttcccttttttcttttcattggtgacgatcacaggagctatcatggcttctcaggcaattcacggtgtctataatctcccaatggattctcttgaagctttcaacatgattcgcgttttttaccgcgataaccaccttgacttcatttcttactgtgcctcagtggtgcggacctatcccgcggtgctgcaggagttggctcaactggttcgagacccggaacgttatgttctgttttgtgccttacattggcagaacaaccatgatgaaggttatgagactgaccctaacccggaacctatggaccaagatgaatctggagatgaacag

SEQ ID NO: 2975 - DNA, 1000 bp, Picornavirales sp.
  isolate RtMrut-PicoV/JL2014-1 polyprotein gene,1
tcatgtgtgtcgcggtccactccctcagcaacccgtctttggacgtgggtactacgatagtgccatccaattcccctaaccttgttaccttccgagcgacctccaacacccgaggtgctcaccaccctgtaaggaaaaatgaaatttcgtctggtgctggctaacagataagatctagcattttccggcccaggctaagaaacctctataaagtagatcgataaacttaaattggcgaactgtacaaagaacggtcctctaccttgccgccacacacacccaaccctaaaatttggcctttagtgtgtggccccttgtgtatgacctcaactcttgcgtacacgcggaatttaacatctttccgctgaaaggagttttcgtgcctccccgattatgtgatgctcgtcctttgctgggcggagcaacgcacgaaacaagccttttctttactaatggaatccaattcccccggtctaagccgcttggaataagacagggttattttcaccccctcttcttctactctcacagagctctattctgtgagaagggaatgttgcgcccctccttcttgggagctcgcttggcggtctttccgtctctgtgcaagagcgagtgcgcaatgtgttagaaggtgaagaaagatattttgggactaacgtttgacacggaacgaaaacgtctgtagcgacctcacaaaggcagcggaacccccctcctggtgacaggagcctctgcggccaaaagccacgtggttagcagccacctttgtgagcggcgtgaacccgacgccacggtttcgttgtgtgacactcactacccccattcggtctttcttaagccctaacacaggtccaccaagaatgtcctgaaggtacctcttcggagatctgatcaggagcttcatgccggtgctttacaccggttcggaagttaaaaactgtcacagtggacccaaatctagatggttctagatttctattggttttaaaatttcatt

SEQ ID NO: 2976 - DNA, 1000 bp, Beihai shrimp virus 1
  strain BHBJDX17672 hypothetical protein 1 and1
aacccgcaccagtgctgtctattagtttacaaagtgatcgcttggcgtaaattattagagagcttgcattgctctcctctacactttctttcgtagagtcattttatttgtccgttgaaacgtattaaaggacctattttgtgtctaaggtcttgtatatgtgtgtggttaaattcatcaaaatcttaactatcactattatatgttattgtcctttgttctatgttgtatgaaagtgtttgtgcttatattcttcaaaacacaaaaacattgttgttgactcctatagtcactatatgtgtatgaatgttgtatgaatgtatcccggattacactaaatgtacctgcttcagcatacaatggctgtgtgtagtaagggtccagcggtgctgcccccatgatagggaggagatttgcttgtgtgtctagaggagtttgttctaccggcggctgaattgctgcgtctgagagacaacttcttgaaccaccgtttgcatttggccttccttgagggatgttcccgtcacgcccggaaccacctgtcctgtcgtatttagtgtgggaaacagtgtaagatggcgttaccagatcgaaactggacctcagcacttcttcgctgagaggctggttatgcaccaccagctaaacaaacaacggttgttcttactaggcactctgtggtggagtagccgaggcgtaggaccattaacataattggagcatacaggcgagaggcccatgttgcgaggtctgtccataggggacctcaagacatcggataccaactctcgggctaagttcagcaataatgcacctctgccggcagtgttctaggcaagtgtcacactccaattccctgttattgtaagacaactaaccttccacatattgacgcccgagcccgaagggactaacgtcgaactgtgagtgcacacagtaaatctagggatctttgggtgagctcccgttatcagctcaatccttttctcatttcgtcacc

SEQ ID NO: 2977 - DNA, 1000 bp, Beihai mudskipper astro-like virus
  strain BHFishC1881592
tttaaaaatttgatgtttttactgcttctgttaatcttcttgcaagttcttttcttcttttactatctattgcatgtggacactggagaactgggacagctctatcctgatctcgactagcctgttactactatcatttatcttttcacctagatcaacaacagtggtagtactgtcttacacagtgctactttatcgcctatggcagacttggaaaatctttgcaagcaactaaaagacttgacaaccaaggttaaccaaattgcccaaagccaaaaacaaacagacccaaaacaacaaagacgcggaagatctaggagccgtagccgctccagagaacgcaaaaacatccgctactttgacgaggacaaggtaaaacctggggatattgtacacgttcgtacttgtccaggtactattactggtaaacactccgattgtcagtggaactacatcgaaatcaaattcccaaagaaacctaaaacagagggttcaaactaagtggtcagaatttgtagccaaacataatttgactgctaccaaaaacacaaacggcaaaacttgtgtcttcctctgtgacgcaacctattgtgacaacgacaacacagagttccaaaattggcgcataacaccaaaccttgaactcttagtttattcgtcaacccaaatttcaggtgggcgtagaacaaccctacagctagcctgtaaaaactactcttgtccttggcgagaagaggttcaacaattacgcaataaaacaatagttagacaccaaccgtgtctacccaaaaatttaactcaaaaaatcttaaacggctcgctttgtaccggtctagaagacggtagtaatctgatctgcgtcaaaaaaccaccaagaccaagaccaacctctctcgcgctagttttcgctagtacgatccaaatacaaacaacaactgtagtgacaaccggttctactactcaaataaccacctcacaacagacaaccaaactaacaaca

SEQ ID NO: 2978 - DNA, 1000 bp, Beihai picorna-like virus 26
  strain BZL93356 hypothetical protein 11
gttgtctcttttgagacagattggcaaccaaacatatatttattatattactactcaagcgtagcccgctagagttaatagctgtcattaacagcgacccctcggcaagaggttaactgtccaaaatcgaatctgatcgaggaagaaatccaaaaacagacgtcgctaacccgctacgaaaacgcggaattattatcgtaggataagaatcgactctatgtcgtgtgcgagtccaacggttcagattacatatgtttgtgacatgtgcaaattcggttgcacaacagccattctttgtaattcatcttattaagaagatggaagaactccctcctatggcgccctgtaatggggattggaggtactctagatttggaaacctggagtgaacgagaacggtttggagcagtggccttttataggtatagactccatctgtaattagttgaattcttagaatcagcctgtatttgatcttacttgttttccacgcaagtattgcagtataggtgctgtccttgtttgacataacgaaggcttgagttattataacacttcgaggaaagtataaagactttattaggtcagtggaaagatctggcgctgtgtttggggttaatagccccctcagcatcaatatagcaatgaagttacgaacagccaaaattttaattccggactttttgtcacacccaattccggttgtggtgatgataaatcatttgcaagagttaaatttcagaagtctaaggcttctaagcttcgtcagaagggaaaggatgctggcaagtttggcgctcccaaggggaggcgaactcagatcgctcagcaattggataaggccaatagggaatataaggcaggtagatataacctgcaggctaatagtggcatcgtcgaggaccttgagaaggtgcgacggagcctcgccggttttaaggcttcaataccgaagaagctcggcaatatttttaacgttattgaggacgtaatattacat

SEQ ID NO: 2979 - DNA, 1000 bp, Beihai picorna-like virus 28
  strain BHZY60695 hypothetical protein1
gaatgtgcaagcacgaattcacctcctgcttgtatgttttccacgaaactagatttttggcaaattagcctccatcatgtttcgtcagcccttgagtaacgggtgcaaatggtataaccctggcatgttgctcaccccaaacccgaccgaaattgtcattaaactaatgtcgaccgaaatgtcattaaactaatctaactatcttttgttctttataagattttagatgtgcatctcaccttgtagatgcttttagccggttttaagaactggcaacccagccccctattccgactctttaagagattaattttagatttggaatgtttttgcagcagtttagctcatgctgactgtttgccccatacttttattagcgtggagtaatttatttaaatcacttgtgaacgattttgaggaatcactgtctagaagatgtcacaaagcgacttagtcgtagttttgctctttacttatgatatattaccgataaatttgaagcatttaaaagtcccacatcagatgggatggtttcgatattgacctctatcacttttacgagtatgaagtgatcgaatttcatgtcatacactgataaaacgcatatctggcgaattgcgggtgttagtgaagtttgtatatggggcctcgtacccccaggcgacgagccgaatacgagtatataggttggttaatttattagcccatatctgcgtgacctgagtaacaacccatgcgggaaaagttacaaattgccacatcgacgtagatctccgcctattggtcaataagcggagaaagtatttatttgactactaacaattatcaacaactttttgtaggatgtgagaatttatcagctcccatctgtgaaatttttgatagtacttttcttgataacactcaagaaacactttttggaccccgcctttgtggtcctcgtttatgtagcgatgcgtatgatcctaaggaatatgcgcgtagcaagtaccggcgtcgt

SEQ ID NO: 2980 - DNA, 1000 bp, Wenzhou picorna-like virus 12
  strain WZFSL74240 hypothetical1
ttttctaacttaaacaagaaaatgccgctcaacttgatgggcgtcattttgttgtcagtgaacagagttcagccaactctatgtatcgcatcatttaatgctctgactttcgggtcatcagatgccttttcttggttatttgataagtatgctatagatttgcgatgtattgtatcacaagagcgctatagatttgcgctgtattgttgacgtcacatgtggcggtaccatggttgaaccctgccgctcatgtgtattcagcacgtcacgtacgtctcgcctgactgcttattttaatgatatagtttgcaaattgtcttttcagaaggtaattatcagttccttgtccaaaattctgattaaccttaggagattatatatctccgcacactagctttactaggtcgagctatttctccccttcataggaggaaaggacatctagactttaagctctttggtcctgagctatttcccgatgggcatacacagatgtccacagtaacaactcgtaaaagaaataaaaatattttgaaaacggaccattacccttacccttgtaacaaaggaactccccttctcaaatttagaaatcccataaaaatctttaaaacagaaatgtaaacaagatccacctttgttgcagagaaccatatgcttgtgaggaaatacactgaatataaatccctaaacgctgggtttcactgtatgagtttcctaacctacacagtcgagagattgtgggctcaattgagtttggttctagacctaagcgcccctcttactagatatagtttgcacttgaggaaatgcgatatgggaaagcgtgcacttacccctgcgaaggaagggtgcatgtgttggaaacagatgtgtagaggttcataaccactcacatgccatacgtactgatcacggtaagagtccgagagctagggtttccccctgaaagtgggatatcccgacaccaggagaaataataggtgataatgtgaaagcg

SEQ ID NO: 2981 - DNA, 1000 bp, Sanxia picorna-like virus 13
  strain SXXX34014 hypothetical protein1
ccatcgagctgtaaggagttagggaaacccctggcagtttatcggtcctgccataaccaaataccgacaccccctcccttcatagtttgtagatattttcaacacgaagcgttgagaacaatagtataacaccatcgcgagcgcactttgtctgtgctactggtcttatatgaggtgtttatacgccactgttatagttttagagaattgttggaattagtggacacatgtccacatgcacgaaatactacgtgagtgcatgctggcttgaccccaaaaacaaaatcaaaattataaatgttcttgccctttgtcggtttagaacatacaaaaatcgcagataggtgcctcttggtgacttaatcagtcccatatcgtactgttgccatcacatatcaatcgtaagtgagacagcgttgctggtggctactctagagaccagcacacagcgtaagctgttcaggtgtccactttacccgagagggtatgtagcagcgattgttgttgtgacacgggcgggtacacctgacttagtaaggttccgattaactggaactctgaaacgttagccccctggaccattagggtcgtgagggttccatgcggagtgcttatcactcctgaatggatatggagcattcacagaagccgcggagtaaaggcccggaggaatgccagtacgtctagctcagccggatgaggagtccggcgttgtcgagacaatgtgtattgcgatgcactaggtaagacagagcgccactgagcctgctcgtggtatgaagggacgtgcacggatctggcaatgtccgatgatggtgataccgtcagctggatgtgaatgtttccagagtcaggcactggatgtagtgccgaagtttccttggtgacgttcctccctttgatgaggtaatgttacaacaaaaacactccgtgcaacccaggaacaatcgcaaaacccctccacccccaaaactaaacacacgacacagatacaacaatc

SEQ ID NO: 2982 - DNA, 1000 bp, Wenzhou picorna-like virus 24
  strain WZSBei69493 hypothetical1
ctttgcctacaacctttatagtttttatgccggcccactttgatttatcaatgtggccccttgatttgtatctcgcgggatacgcccatacatttccggcatcctatttgatatttcattcgaattattttattaacatataatatttatttattcgttagtcactataattagtgcaaccggtcttcgggccattattagtccttttattagttctatcacgtgtcttcgggcacacaaatagtaaagtatttttattagatctctggagcatttaagatgctatagccttaacgaactggcgtttatcggctttttaaattgaacggtatggttaccacattgcccgggagcctattttaagctttttcctttagcggggaattatcacttattttagaataaactcctttatccaggtgactaggtattcctatcaagccaagtttcaactattaagtgtcaggataagtctttagagttaagttgcacatcgctgcgcgttgagtgcgtagttacccatggtgtgcattttgctatgataaccatcttgcatgtttcatgtcttttattaatgaggtagttgttctataacagcatttcggctgagaagctgaggtgttggaacactaatgtttacccacctatcgaatattctatacactgggttaactgcccgtatagtcttaaactagttccttctattttatctagacatggaaaagcaattcctacccctcgagtcggggaaactaattctcttcaacacatactagtctcttcggagagtgttgaagcccttaatcattcttgtaatgaacatgtgcagttacatggtttatttcattttactgccaagtgtagttgtttcaatgttgacttgattgtctcaaaggatgacacacacgaatcaaaagtggatctatcttcggatgattccaatgtcaaagaagtactatttactgagagcgattatttttcgatttcgcaacagacaggg

SEQ ID NO: 2983 - DNA, 1000 bp, Beihai picorna-like virus 9
  strain BHBJDX18814 hypothetical protein1
cctaaaaatatatgtgtgaattgctctccgtgaaaggagatactgatcatgtaataggtgctttaagcactgaagctgcaagaactacagcgtaatcaacgcgaaccccgcttgctcagcgggaaataaatagagcatttttggtaatcttcttacctctgaatatagaaaaagaagacgtcgttcgaagccggaacgtaatccggattttacattacagtaccttcgcgtaggtgcagtaacaaatagttggtggagccaaccgtctagatatagtgatctaggacacactaccactttttaattttacattataaagaacacacgaactcacctcttggcgggctacgtaacgtagttttgaggttctcttataggtatacttatcctgttagagagtgcgatgtacggcatggagcagtaatatacttttatagtattcagactgtgttcgttacttatatttgtaataaatattgattagtggtcagctctttcatcttatcccaaggctttattcgaccttgggtgtttgttagagtgtgtggcttgttagactgaagcaaaggcttgagcttcgacttttcgagcaaagaattagaatagatctggcgccgttgggcttaactagcccctcggcatcaaatagcatgaaattactaacgccttttcaaaagtactagaccctctttcctttgaaggaggaacttacgatttgtactctccccaatcttttaatttgtggtcaagatggcaatttattagcaaatacttggcacgggaactttctaaagaagttctttccaaaattgaaggattggtggctttgtttttggcactcagtgaggttcagacggagaaaggtttcttgtctgtgttaatactttatgtaaaaacacattgtgacgagtctcttattaaattcgtgactgaacaggttgcagtcctgtttaagggctatacggcacagagttctggccgtccaaagtggttggatgat

SEQ ID NO: 2984 - DNA, 191 bp, Unknown
  Description of Unknown: SF573 Dicistrovirus sequence
aaaaccgaccccagagatcagaaagtcgttgacgcgatcttttattagaggacgttgcgctggcgcgagctttaattagcagacgccaaaaataaacaacaaaatgctgatcgcgagacttaattgtcagacgattggccaaatccgatgtgatctttgctgctcccagattgccgaaataggagtagtag

SEQ ID NO: 2985 - DNA, 193 bp, Unknown
  Description of Unknown: CRPV sequence
aaaagcaaaaatgtgatcttgcttgtaaatacaattttgagaggttaataaattacaagtagtgctatttttgtatttaggttagctatttagctttacgttccaggatgcctagtggcagccccacaatatccaggaagccctctctgcggtttttcagattaggtagtcgaaaaacctaagaaatttacct

SEQ ID NO: 2986 - DNA, 675 bp, Chicken orivirus 1
aaaccctcacgagtgcttgtggtaggtcccaggccaatattcttcgtaaggcttggttccaattttccaccactcgtgtttgggttctggcctatggtacccagaggggcggtttgggggaattaactccccctcccctgtggtcctataccaccccacacctctgtgggctttctttactatcttcttgttttccgacttttaaacactaggcaggcgcgcctagtcatacaccgcccggctggtctttccagctcttgtgggcggtgcgcgctggtccatcgtgcccagcgacatagcaccttgtggacacctccgaacgccctcccctgtatggggtggtgcccaggggtttcagtgtggtgacacactccctggggcccgaaaggctagtgtgcaacaggtgaggtacagccagctgcccccgtggctggagggaccaagcttgtgaagcacacctcaccttcttgggggtgggctagtaagtggtgaaagcatagtgtccgtgtcgctggccaacactttgggtcaagtccagccactcagtgagtagatgcccaggaggtacccctagtggatctgacttggggcctgttacttaatgcaggttaaaaactatgaaagctgagtagtgtagcccggctggtggcttctcttccttattcattctatttt

SEQ ID NO: 2987 - DNA, 630 bp, Unknown
  Description of Unknown: PV1.0 sequence
aacaaaaggctacaccacttgggctacggcccgcgccaccttgtggcgcaaagacattagaagaatagcataccgcccactagggccctgcagccagcagggtaacgggcaagcacttctgtctccccggtagaacggtataggctgtacccacggccgaaaactgaactatcgttacccgactccgtacttcgcaaagcttagtaggaaactggaaagttcgagttattgacccggagtgttccccccactccagaaacgcgtgatgagggttgccaccccgaccatggcgacatggtgggcatccctgcgctggcacgcggcctctaagaggataactcgctcctactggtaaccgaagagccccgtgagctacggtttattcctccgcctccctgaatgcggctaatcctaacccatgagcagttgccatagatccatatggtggactgtcgtaacgcgtaagttgtgggcggaaccgactactttgggatggcgtgtttccttgttttctccatttgttgttgtatggtgacaagttatagatctcgatctatagcgtttcttgagagatttccaaacatttattcaagtcgtacaattcttgtgtttaagcagtacagtgtaacc

SEQ ID NO: 2988 - DNA, 630 bp, Parabovirus
  5?48
aacaaaaggctacaccacttgggctacggcccgcgccaccttgtggcgcaaagacattagaagaatagcataccgcccactagggccctgcagccagcagggtaacgggcaagcacttctgtctccccggtagaacggtataggctgtacccacggccgaaaactgaactatcgttacccgactccgtacttcgcaaagcttagtaggaaactggaaagttcgagttattgacccggagtgttccccccactccagaaacgcgtgatgagggttgccaccccgaccatggcgacatggtgggcatccctgcgctggcacgcggcctctaagaggataactcgctcctactggtaaccgaagagccccgtgagctacggtttattcctccgcctccctgaatgcggctaatcctaacccatgagcagttgccatagatccatatggtggactgtcgtaacgcgtaagttgtgggcggaaccgactactttgggatggcgtgtttccttgttttctccatttgttgttgtatggtgacaagttatagatctcgatctatagcgtttcttgagagatttccaaacatttattcaagtcgtacaattcttgtgtttaagcagtacagtgtaagg

SEQ ID NO: 2989 - DNA, 675 bp, Parabovirus B
aacccataatccattgtccatcaatgttttatgggggggaccctttctcccctccccctccaaataccttttacccctctgtaaccaagagtgtgcaaaatctatttactagcccagaattgcggcttctggggaggtttattcctcatgcctaacaagatgttacgcaaactccgggctacggccctgggcttttgccctaaagatttagaagtttacactatcgtccaacaggaggacaacaaaccagttgttctaaggacaagcacttctgtttccccggtgagactggatagactgtacccacggttgaaactggttgatccgttacccgactcactacttcgagaagattagtaggaaactgtgaaactgattccattgatccggatactttccccgtatccagaaactactgatgagggttgacttcccgactacggcgacgtagtgtcatccctgcgctggcagtaggcctctttgaggatggaagatgtggatcggtaaccgaaggtcctattgagctagtgtttatacctccggcctcctgaatgcggctaatcctaacccatgatctagtgctcacaaaccagtgagtagctagtcgtaacgcgtaagtcgtgggcggaaccgactactttggagtgaccgtgtttcctattttacttttgtttg

SEQ ID NO: 2990 - DNA, 636 bp, Echovirus E30
aagcaaggcaaacctgaccaatagtaggtgtggcacaccagccgcattttggtcaagcacttctgtttccccggaccgagtatcaataagctgctcacgcggctgaaggagaaaccgttcgttacccgaccagctacttcgagaaacctagtaacactatgaacgttgcggagtgtttcgttcagcacttcccccgtgtagatcaggtcgatgagtcaccgcattcctcacgggtgaccgtggcggtggctgcgttggcggcctgcctacgggttcgcccgtaggacgctctaataccgacatggtgtgaagagtccattgagctagctggtagtcctccggcccctgaatgcggctaatcctaactgcggagcaggtgctcacagaccagtgagtagcctgtcgtaacgggcaactctgcagcggaaccgactactttgggtgtttttccttttttcttctcttatattggctgcttatggtgacaattaaagaattgttaccatatagctattggattggccatccggtgacgagcagagccattgtttacctctttgttggatttgtacctttgaaccacaaagtcttgaataccattcatctcattttaaagttcaactcagctaaaagaaa

SEQ ID NO: 2991 - DNA, 675 bp, Equine rhinitis A virus
aagggttactgctcgtaatgagagcacatgacattttgccaagatttcctggcaattgtcacgggagagaggagcccgttctcgggcacttttctctcaaacaatgttggcgcgcctcggcgcgccccccctttttcagccccctgtcattgactggtcgaaggcgctcgcaataagactggtcgttgcttggcttttctattgtttcaggctttagcgcgcccttgcgcggcgggccgtcaagcccgtgtgctgtacagcaccaggtaaccggacagcggcttgctggattttcccggtgccattgctctggatggtgtcaccaagctggcagatgcggagtgaaccttacgaagcgacacacctgtggtagcgctgcccagaagggagcggagctcccccgccgcgaggcggtcctctctggccaaaagcccagcgttaatagcgccttctgggatgcaggaaccccacctgccaggtgtgaagtggactaagtggatctccaatttggcctgttctgaactacaccatctactgctgtgaagaatgtcctgaaggcaagctggttacagccctgatcaggagccccgctcgtgactctcgatcgacgcggggtcaaaaactgtctaagcagcagcagaaacgcgggagcgtttctttttcctcatttgtttc

SEQ ID NO: 2992 - DNA, 576 bp, Equine rhinitis A virus
  U188
aatattggcgcgcgcatttgcgcgcccccccccatttcagccccctgtcattgactggtcgaaggcgttcgcaataagactggtcgtcacttggctgttctatcgtttcaggctttagcgcgccctcgcgcggcgggccgtcaagcccgtgcgctgtatagcgccaggtaaccggacagcggcttgctggattttcccggtgccattgctctggatggtgtcaccaagctgacaaatgcggactgaacctcacaaagcgacacacctgtggtagcgctgcccaaaagggagcggaactcccccgccgcgaggcggtcctctctggccaaaagcccagcgttaatagcgccttttgggatgcaggagccccacctgccaggtgtgaagtggagtgagtggatctccaatttggtctgttctgaactacaccatctactgctgtgaagaatgccctggaggcaagctggttacagccctgaccaggggccctgcccgtgactctcgatcggcgcagggtcaaaaattgtctaagcagcagcaggaacgcgggagcgtttcttttccctttgtatcgac

SEQ ID NO: 2993 - DNA, 612 bp, Vilyuisk human encephalomyelitis virus
aattccttcttcctttctccttggacctcggtcccccggtctaagccgctcggaatatgacagggttattttcacctcttctctcttctacttcatagtgttctatactatgaaagggtatgtgtcgccccttccttcttggagaacgtgcgtggcggtctttccgtctctcgaaaaacgtgcgtgcgacatgcagagtaacgcaaagaaagcagttcttggtctagctctggtgcccacaagaaaacagctgtagcgaccacacaaaggcagcggaaaccccctcctggtaacaggagcctctgcggccaaaagccacgtggataagatccacctttgtgtgcggtgcaaccccagcaccctggtttcttggtgacaccttagtgaaccctcgaatggcaatctcaagcgcctctgtaggaaagccaagaatgtccaggaggtaccccttcctcatggagggatctgacctggagacacatcacacgtgctatacacttgtgcttgtgtttaaaaattgtcacagctttcccaaaccaagtggtcttggttttcccttaacttcgaaaagtcactatggcctgcaaacatggatacccagacgtgtgccct

SEQ ID NO: 2994 - DNA, 675 bp, Foot-and-mouth disease virus
  O isolate
acaagcttgacaccgcctgtcccggcgttaaagggaagtaaccacaagcttacaaccgcctaccccggtgttaatgggatgtaaccacaagatacaccttcacccggaagtaaaacggcaaattcacacagttttgcccgtttttcatgagaaacgggacgtctgcgcacgaaacgcgccgtcgcttgaggaggacttgtacaaacacgatctaaacaggtttccccaactgacatacaccgtgcaatttgaaactccgcctggtctttccaggtctagaggggtaacactttgtactgtgcttgactccacgctcggtccactggcgagtgttagtaacagcactggtgcttcgtagcggagcatggtggccgtgggaactcctccttggtaacaaggacccacggggccgaaagccacgtcctgacggacccaccatgtgtgcaaccccagcacggcaacttttctgtgaaactcactctaaggtgacactgatactggtattcaagtactggtgacaggctaaggatgcccttcaggtaccccgaggtaacacgcgacactcgggatctgagaaggggactggggcttctgtaaaagcgcccagtttaaaaagcttctatgcctggataggtgaccggaggccggcgcctttccattataactactgacttt

SEQ ID NO: 2995 - DNA, 675 bp, Hunnivirus A2
acagtttttgacaaggaccctcacctgtcaatcgggaccaccactttcagtgaccccgtgcgaagtgttgagagaaagtgagctttcttacccttcatttgtgaacccttcagtcgaagccgcttggaataagatggaaggaaatgttcattctaaatggagtgaaacatatacttaatttccagtgtttagtggtctttccactagacaacggcactgtcttgccggaactctacacaccaacattccacgcttgtgggactcaaatgttggatgacacagttgtagctggaactgagtgtttagtgcactctgtgtaacagtgaaaacaatgtgatcacttcggtgggctagtagcctgtggactaacaactggtaacagttgcctcaggggccaaaagccacggtgttaacagcaccctactagtttgattggagcaatccatgatgttacagagttagtaactgccaaacagattgtactggtatcttggcataccgtgcaacttaggatagtgaaggatgccctggcggtacccataggtaacaagtgacactatggatctaaacaggggctcactctacgttgctttacaactagctgtgagttaaaaaacgtctaactatccacaacctaggggactaggttttcctttttatttttatacacaacta

SEQ ID NO: 2996 - DNA, 319 bp, Unknown; identical to SEQ ID NO: 304
  Description of Unknown: PLV-CHN sequence

SEQ ID NO: 2997 - DNA, 675 bp, Posavirus 1
acatttccttgcgtgcgcacccgaaaatttattgaacttggcttgaatcataagtaatgcttcttatagcggacactttgagaatataatgcttgtatggattaatgtatactgttttaaataacaaacctagacacgcagttgcgttgatggttgtatcaatcacatataagtgttgaactcgtgttaatcctcgatcgctatatgtttgccgcctacttccaataaaatagattacatgcgcgtcatgcctttgtgggttacctattggcctctgacaaaaacaagtcgtaagatttgtagcttcccggtgtaaaaagctgggcgcggtctggctctcgtagggtggaaaggtccaccaatggctggttgagtgtaagctccggtgtcctggttgtcgcaattccaggcgtcgtaataacctatattgcatctgactctaactcttgtggctctactgtatctagttcttgttctactaactctaataatactactggctctaatactgaaaaacttacatatgttaatatagataatatccttgatcctgatatccctcacgtcactgaagttcgccgaaaacgaatttcagatcatatcattgaatctcaaggatgtacttgctctgaacctactataactcctcatgcgttttcattttctactcttggc

SEQ ID NO: 2998 - DNA, 107 bp, Rinderpest virus
accaaacaaagttgggtaaggatcggtctatcaatgattatgatttagcacacttaggattcaagatcctatcgactggagcaggcttaaggtaaaggttctttaaa

SEQ ID NO: 2999 - DNA, 134 bp, Unknown
  Description of Unknown: Avian paramyxovirus penguin sequence
accaaacaaggactagataacccacgtgaccgttaactggaaaataagatgttgtaggggcgacctagttggaattcgaccccggctccgaaacctctaattgtggttattggcagtctagtctacttctaacg

SEQ ID NO: 3000 - DNA, 121 bp, Newcastle disease virus
accaaacagagaatctgtgaggtacgataaaaggcgaagaagcaatcgagatcgtacgggtagaaggtgtgaaccccgagcgcgaggccgaagctcgaacctgagggaaccttctaccgat

SEQ ID NO: 3001 - DNA, 145 bp, Mumps virus
accaaggggaaaatgaagatgggatgttggtagaacaaatagtgtaagaaacagtaagcccggaagtggtgttttgcgatttcgaggccgggctcgatcctcacctttcattgtcgataggggacattttgacactacctggaaa

SEQ ID NO: 3002 - DNA, 107 bp, Dolphin morbillivirus
accagacaaagctggctaggggtagaataacagataatgataaattatcatacttaggattaatgatcctatcaattggcacaggatttggataaaggttcacagtc

SEQ ID NO: 3003 - DNA, 107 bp, Canine distemper virus
accagacaaagttggctaaggatagttaaattattgaatattttattaaaaacttagggtcaatgatcctaccttaaagaacaaggctagggttcagacctaccaat

SEQ ID NO: 3004 - DNA, 675 bp, Human poliovirus 1
  strain EQG1419328
acccttgtacgcctgttttatactcccctccccgtaacttagaagaaacaaaataagttcaataggagggggtacaaaccagtaccaccacgaacaagcacttctgtctccccggtgacattgcatagactgtccccacggttgaaagcaattgatccgttacccgctcttgtacttcgagaagcctagtaccatcttggaatcatcgatgcgttgcgctccacactcagtcccagagtgtagcttaggctgatgagtctggacattcctcaccggcgacggtggtccaggctgcgttggcggcctacctgtggcccaaagccacaggacgctagatgtgaacaaggtgtgaagagcctattgagctataagagagtcctccggcccctgaatgcggctaatcccaaccacggatcaagggtgcacgaaccagtgtataccttgtcgtaacgcgcaagtccgtggcggaaccgactactttgggtgaccgtgtttccttttattatttcaatggctgcttatggtgacaatcattgattgttatcataaagcgaattggactggccatccggtgaaagtgaaacatattgtttgcctcctcgttgggtctacttcaaccaatctttacttacaatcttaccactacagttttgctggttagaagtgtgtttcacg

SEQ ID NO: 3005 - DNA, 675 bp, Unknown
  Description of Unknown: Parabovirus A3 sequence
accgttacgcaccactcagttggtgtttggtggcaccaatgatggaacaaaaggctacaccacttgggctacggcccgcgccaccttgtggcgcaaagacattagaagaatagcataccgcccactagggccctgcagccagcagggtaacgggcaagcacttctgtctccccggtagaacggtataggctgtacccacggccgaaaactgaactatcgttacccgactccgtacttcgcaaagcttagtaggaaactggaaagttcgagttattgacccggagtgttccccccactccagaaacgcgtgatgagggttgccaccccgaccatggcgacatggtgggcatccctgcgctggcacgcggcctctaagaggataactcgctcctactggtaaccgaagagccccgtgagctacggtttattcctccgcctccctgaatgcggctaatcctaacccatgagcagttgccatagatccatatggtggactgtcgtaacgcgtaagttgtgggcggaaccgactactttgggatggcgtgtttccttgttttctccatttgttgttgtatggtgacaagttatagatctcgatctatagcgtttcttgagagatttccaaacatttattcaagtcgtacaattcttgtgtttaagcagtacagtgtaagg

SEQ ID NO: 3006 - DNA, 384 bp, Hepacivirus A
acctccgtgctaggcacggtgcgttgtcagcgttttgcgcttgcatgcgctacacgcgtcgtccaacgcggagggaacttcacatcaccatgtgtcactccccctatggagggttccaccccgcttacacggaaatgggttaaccatacccaaagtacgggtatgcgggtcctcctagggcccccccggcaggtcgagggagctggaattcgtgaattcgtgagtacacgaaaatcgcggcttgaacgtctttgaccttcggagccgaaatttgggcgtgccccacgaaggaaggcgggggcggtgttgggccgccgccccctttatcccacggtctgataggatgcttgcgagggcacctgccggtctcgtagaccataggac

SEQ ID NO: 3007 - DNA, 340 bp, Hepatitis C virus
  QC64
acctgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggacatttgggcgtgcccccgcaagactgctagccgagtagcgttgggttgcgaaaggccttgtggtactgcctgatagggtgcttgcgagtgccccgggaggtctcgtagaccgtgcatc

SEQ ID NO: 3008 - DNA, 675 bp, Unknown
  Description of Unknown: A115-675 sequence
acctttgtgcgcctgttttataccccccccaacctcgaaacttagaagtaaagcaaacccgatcaatagcaggtgcggcgcaccagtcgcatcttgatcaagcacttctgtaaccccggaccgagtatcaatagactgctcacgcggttgaaggagaaaacgttcgttacccggctaactacttcgagaaacccagtagcatcatgaaagttgcagagtgtttcgctcagcactacccccgtgtagatcaggccgatgagtcaccgcacttccccacgggcgaccgtggcggtggctgcgttggcggcctgcctatggggcaacccataggacgctctaatacggacatggtgcgaagagtctattgagctagttagtagtcctccggcccctgaatgcggctaatcctaactgcggagcacatacccttaatccaaagggcagtgtgtcgtaacgggtaactctgcagcggaaccgactactttgggtgtccgtgtttccttttaatttttactggctgcttatggtgacaattgaggaattgttgccatatagctattggattggccatccggtgactaacagagctattgtgttccaatttgttggatttaccccgctcacactcacagtcgtaagaacccttcattacgtgttatttctcaactcaagaaa

SEQ ID NO: 3009 - DNA, 675 bp, Unknown
  Description of Unknown: A110-675 sequence
acctttgtgcgcctgttttataccccctcccccaactgtaacttagaagtaacacacaccgatcaacagtcagcgtggcacaccagccacgttttgatcaagcacttctgttaccccggactgagtatcaatagactgctcacgcggttgaaggagaaagcgttcgttatccggccaactacttcgaaaaacctagtaacaccgtggaagttgcagagtgtttcgctcagcactaccccagtgtagatcaggtcgatgagtcaccgcattccccacgggcgaccgtggcggtggctgcgttggcggcctgcccatggggaaacccatgggacgctctaatacagacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcctatactggctgcttatggtgacaattgagagatcgttaccatatagctattggattggccatccggtgactaatagagctattatatatccctttgttgggtttataccacttagcttgaaagaggttaaaacattacaattcattgttaagttgaatacagcaaa

SEQ ID NO: 3010 - DNA, 675 bp, Unknown
  Description of Unknown: Human coxsackievirus A2 sequence
acctttgtgcgcctgttttatatccccaccccgagtaaacgttagaagttacgcaaccccgatcaatagtaggtgtagcactccagctgcatcgagatcaagcacttctgtctccccggaccgagtatcaatagactgctaacgcggttgaaggagaaaacgttcgttacccggccaattacttcgagaagcccagtagtgccgtgaaagttgcggagtgtttcgctcagcacttcccccgtgtagatcaggctgatgagtcaccgcgatccccacaggtgactgtggcggtggctgcgttggcggcctgcctatggggcaacccataggacgctctaatacagacatggtgcgaagagcctattgagctaattggtagtcctccggcccctgaatgcggctaatcctaactgcggagcacatgccctcaaaccagggggtggtgtgtcgtaacgggtaactctgcagcggaaccgactactttgggtgtccgtgtttctttttattcttataatggctgcttatggtgacaattaaagaattgttaccatatagctattggattggccatccggtgactaacaaatcgctcatataccagtttgttggttttgttcccttatcacatacagctcataacaccctcttatatttactacaattgaatagcaagaa

SEQ ID NO: 3011 - DNA, 675 bp, Bat Iflavirus
acgaatcggtatacgcttcggtacctattgttgcaagttcgttccctattttcgatttgcctgcccgaatttgactcaaacaattgtgacatactatgtctctgtttgaaagcactacacgagtttgcgcccagcatgtatgttttcaagtcttttgtataagtctgcctctatagtggttttctttgaccttaaagccttgtcaaccatcctatatgctgcatcgagacttgatgtcaatctgcctctactacgcaaatgtctagtaattagttataaggttttactattttccctcatttccaattttagtttgtagtgtatgtgagtatcattcttactccgactgttaagagaaaccaatttatagtcgttaaatatgataaatggaatgaatgatggtgtcattttaaaaacactcttctctataggcgtaagcattctcgctcttagagtcgtaaagaagaaatgccgtgtctatcagtatgttatgcgatttattttctgccacgcgcttctagtgcaatctagttgacatacagacattgcctaccactcgcgagggtcgaccggtagtgtaaggagtaagtgatgatttccgcttattctgtaccctttgcctggtgaggacagatcctgactaattttaaatataaatgaacactagcttccaag

SEQ ID NO: 3012 - DNA, 143 bp, Farmington virus
acgacgcataagcagagaaacataagagactatgttcatagtcaccctgtattcattattgacttttatgacctattattagacccttcacgggtaaatccttctccttgcagttctcgccaagtacctccaaagtcagaacg

SEQ ID NO: 3013 - DNA, 675 bp, Unknown
  Description of Unknown: Poecivirus BCCH-449 sequence
actacacaatcgcaacacgcgcaagtttgtagtttgattggcgtgcaaatgtcaaatcaagcatataacacaatttggtggctgttggtgtttgttataggaattttggttgtgttgaaattgtggatgtgtaggaaatatgcacaattacgtcagcgtcaggagttttataacctggcgcaacaccaaaatggtcttcgcgctttaacatcaccagcgaggtgtaaacaaattgaagttgaattagatcgtgtataggccagggaaccatccctcccaacgccacatcttgtggggaagttgggataatggtgggtctatatgaattggtctgtagacccacagtgaagagtgaatagtatgcttgcggttccatttgttaatggtctagcatgggtgggggcggcaaccccgtgaggggttccccactggccaaaagcccaggggttagtcatttcaaccaaggaagctggtaacctggtgacctgaacttgagtggtgagacccccttgctagagtgtgtaaaccgattgtaagcattttgtttgcttagtatctgtggtataagcagtcaattttgtataggctcaaggctgtggtagttagtagatgcccggaaggttattactgatccggggaccgtgactatacattaggtaaaccggtttaaaaacc

SEQ ID NO: 3014 - DNA, 675 bp, Unknown
  Description of Unknown: Aichivirus Rt386 sequence
actccattcagcttcttcggaacctgttcggaggaattaaacgggcacccactttcctgtcctctccccctttctgcaactcaagtgtgtgctcgtaatcctgactcccacgggttgaccgccccgttggtgaacaaacagctaggtcattccctccctacccctgggcgccatttcagtggcgttcatatcctccccccagcctgacgtgtcacaggctgtgcaaagtccccgcgaaagctgctcacgtggcaattgtgggtcccccctttgtgaaggaaccgagtctttctcccttaaggctagacccctgtgtgaactcacaggtggcaactagtggttccactgcatgctcccgacctcggccgcggagtgctgttccccaagtcgtgacactgacctccacttatgtgcctggcaagcatatctgagaagatgttccgctgtggctgccaaacctggtaacaggtgccccagtgcgtgtagtcttcttccgtctccggacggtaagtgtgtggtaaagatgcggcgtaaggttcaagtgccaacgccctggaagggatgacccttctactgccctaggaatgccgcgcaggtaccccaggttcgcctgggatctgagcgcgggctaattgtctacgggtagtttcatttccctctcttttcactggcatc

SEQ ID NO: 3015 - DNA, 675 bp, Unknown
  Description of Unknown: Aichivirus Goiania sequence
actccattcagcttcttcggaacctgttcggaggaattaaacgggcacccatacacccccatccccttttttgcaacttaagtatgtgtgctcgtaatcttgactcccacggaatggatcgatccgctggagaacaaactgctagatccacatcctccctcccccctgggaggacctcggtcctcccacatcctccccccagcctgacgtatcacaggctgtgtgaagcccccgcgaaagctgctcacgtggcaattgtgggtccccccttcatcaagacaccaggtctttcctccttaaggctagtcccgatgtgtgaattcacatcgggcaactagtggtgtcactgtgcgctcccaatctcggccgcggagtgctgttccccaagccaaacccctggcccttcactatgtgcctggcaagcatatctgagaaggcgttccgctgtggctgccagcctggtaacaggtgccccagtgtgcgtaaccttcttccgtccccggacggtagtgattggttaagacttggcgtaaggttcatgtgccaacgccctgtgcgggatgaaacctctactgccctaggaatgccaggcaggtaccccaccttcgggtgggatctgagcctgggctaattgtctacgggtagtttcatttctaattctttcatgtcggagtc

SEQ ID NO: 3016 - DNA, 675 bp, Enterovirus sp.
  isolate CPML
actctggtatcacggtacctttgcacgcctattttataccccttccccatcgtaacttagaagcaacaaacaaactgcccaatagcagcacaacacccagttgtgttaggggcaagcacttctgtttccccggaagggtctgacggtatgctgtacccacggcagaagtatgacctaccgttaaccggccatgtacttcgagaagcctagtaccattatgaaggttgattgatgttacgctccccagcaaccccagctggtagttctggtcgatgagtctcggcattccccacgggcgaccgtggccgaggctgcgttggcggccagcctacaccatacggtgtaggacgtcaagatactgacatggtgtgaagagcctattgagctacgtggtagtcctccggcccctgaatgcggctaatcctaactccggagcatccgccagtaagcccactggaagggtgtcgtaatgcgaaagtctggagcggaaccgactactttgggtgtccgtgtttcctgttttacttattgtttggctgcttatggtgacaacttatagttatcatcataagctacttggtcttgccaaccggagaattatttggttatttgttggtttcataaacctacagtcgtattttcctgtcttattaattgttctcaaaattaacaaca

SEQ ID NO: 3017 - DNA, 248 bp, Unknown
  Description of Unknown: Yc-3 sequence
actgaagatcctacagtaactactgccccaatgaacgccacagatgggtctgctgatgactacctatcttagtgctagttgaggtttgaagtgagccggtttttagaagaaccagtttctgaacattatcatccccagcatctattctatacgcacaagatagatagtcatcagcagacacatctgtgctactgcttgatagagttgcggctggtcaacttagattggtataaccagttgagtggcaa

SEQ ID NO: 3018 - DNA, 528 bp, Avian infectious bronchitis virus
acttaagatagatattaatatatatctattacactagccttgcgctagatttttaacttaacaaaacggacttaaatacctacagctggtcctcataggtgttccattgcagtgcactttagtgccctggatggcacctggccacctgtcaggtttttgttattaaaatcttattgttgctggtatcactgcttgttttgccgtgtctcactttatacatctgttgcttgggctacctagtgtccagcgtcctacgggcgtcgtggctggttcgagtgcgaggaacctctggttcatctagcggtaggcgggtgtgtggaagtagcacttcagacgtaccggttctgttgtgtgaaatacggggtcacctccccccacatacctctaagggcttttgagcctagcgttgggctacgttctcgcataaggtcggctatacgacgtttgtagggggtagtgccaaacaacccctgaggtgacaggttctggtggtgtttagtgagcagacatacaatagacagtgacaac

SEQ ID NO: 3019 - DNA, 292 bp, Human coronavirus 229E
acttaagtaccttatctatctacagatagaaaagttgctttttagactttgtgtctacttttctcaactaaacgaaatttttgctatggccggcatctttgatgctggagtcgtagtgtaattgaaatttcatttgggttgcaacagtttggaagcaagtgctgtgtgtcctagtctaagggtttcgtgttccgtcacgagattccattctacaaacgccttactcgaggttccgtctcgtgtttgtgtggaagcaaagttctgtctttgtggaaaccagtaactgttccta

SEQ ID NO: 3020 - DNA, 310 bp, Feline infectious peritonitis virus
acttttaaagtaaagtgagtgtagcgtggctataactcttcttttactttaactagccttgtgctagatttgtcttcggacaccaactcgaactaaacgaaatatttgtctctctatgaaaccatagaagacaagcgttgattatttcaccagtttggcaatcactcctaggaacggggttgagagaacggcgcaccagggttccgtccctgtttggtaagtcgtctagtattagctgcggcggttccgcccgtcgtagttgggtagaccgggttccgtcctgtgatctccctcgccggccgccaggaga

SEQ ID NO: 3021 - DNA, 436 bp, Coronavirus AcCoV-JC34
agaaacaagtagtgttttaaaaaccttcaaattagtgcctgtaacatctttgcaatgaaagtagcgctcactagcctctatgcaaagaatgttaaaagaaatacgaagcatttaaagaatacaatctatctaggataggtacaattctcctccccctcttgacttcggtcaactcaactcaactaaacgaaatcccccttgcatggttccgacccgtgtaaggttgtgtatttcgtgcagtcgttgcccttactagtgtaagcgtaacggcatctaggtttgcacgtcttggaggaaacggtgtgtacgtttctagtgtttacgccgtatcggttccggcccgataggtattgcattagacgtcctgggtggttctgcctgcccttgtgtgattcggctgttccgtcagtttggtcacctcacacgtccttaagac

SEQ ID NO: 3022 - DNA, 393 bp, Unknown
  Description of Unknown: Equine Pegivirus 1 sequence
agaatggggagttaactcctggcactggcccgaagcatgaactgatcgcggtggcagggttcttcgggtaaatcccggccgcgtgttgtgattgtgttagggcaggtgacagtcggcagggtcgaccccctgcttcaggaccactgtcttcctggacgaccgttgctgaaaaagggccgccacggtctgtagctcgccgacgcttctaattcaggccggaggaccacgctccgtaatcgagcccaagtactcaaaccccagcacccctgggtcacgccctacgccgcccttttaacgcttcggctaatagggtctatccggcgggttgacaaagggcgcagggttacctggtactacgagcttgggtgtccctgggagtaatcccagggtgcc

SEQ ID NO: 3023 - DNA, 524 bp, Unknown
  Description of Unknown: Pegivirus I sequence
agaatggtctaagtggttgccaccgtggtccgaaggggaggaggacctacgctgccagggttggcaggtcgtaaatcccgggtgtaggagatccctccttgttaggactgctggtagctggggggtcggtgaccccctgggcaaccgccaaacccggacgaccgggtggcggctccatgttggcacggtccacaggtgtgaaccctaccggtgtgaataagggttggtggttgcggtccaccttaaacgtagtatgcattgggcttggtaaaacaccgctcgtagtacggaacgccgcctttaaagacacagtaggcgtagccggcgggttgacaatccatacggggggtggggtgtggtcatggatctgtccacaccaccttcatgcggccctctaagcaagccataccggggggaggcgcgcggcaccgcactgccgggcaaggggaagaaccttcgggtgacccccccccaaccaccgtccgatcaatgctaatgttgcgtttaggcgtgacaccggcaca

SEQ ID NO: 3024 - DNA, 537 bp, Unknown
  Description of Unknown: Pegivirus K sequence
agaatggtgtgatccgtcgccgctccagcggaaagcgggcgggatctagtggttagggttgttcgcgtaaatcccacactagtggtacgctcgtataacgtgggagcagccggtggggtcgaccccccacctggcggctgctgagcaccggacgaagcgcggggggtgaacgctaacccgcggcccgggctgccaacgttaggcacgtcttggctggaagacgttaaacacagggccccccctcaaccctgatccgaggccagagaccaaggtacgccgcccttttaaaggcgttactcgtccaataggatctctccggcgggttgtcaaaccttgctggccctggtgatggttacgggagggggtggggcggggagtagaagccccgcccggcatgggggtaccaagctcggcacgcccagcacgcgtggcgtaggggaaaaatccttcgggtgacccctggtaccataaagtaattaacatgagcatgccgctagggtgtgctttttcttccttccttgggaaggcggtggcacc

SEQ ID NO: 3025 - DNA, 631 bp, Parechovirus A3
agagtccttttcccagccagaggtggctggttaaataatacctactgtaacaaaacatctaagatgtaacaaccacacacctggtctccactggccgaaggcaactagcaataaggcaggtgggttcagacgcttaaagtgtgttgtacatattcttttctaacctgtgttttacacagggtggcagatggcgtgccataactctaacagtgagataccacgcttgtggaccttatgctcacacagccatcctctagtaagtttgtaagatgtctgatgacgtgtgggaacctgttggagataacagtttgctgcaaagcatcccactgccagcggatctacatctggtaacagatgcctctggggccaaaagccaaggtttaacagaccctttgggattggttcaaacctgaactgttatggaagacatttagtacctgctgatttggtagtaatgcaaacactagttgtaaggcccacgaaggatgcccagaaggtacccgtaggtaacaagtggcactatggatctgatctggggccagctacctctatcttggtgagttggttaaaaaacgtctagtgggccaaacccaggggggatcctggtttctttttaatttaagtaatcact

SEQ ID NO: 3026 - DNA, 675 bp, Hubei picorna-like virus 2
agcaacttctttctgaaaactagctagagttcgacgatctctctggctaatgacaaataaccaatcaaaaagtcaaatgttcatgtatatatatatttagtagtgacctttatttagaaaaactttagatgatttatcgtcaagttgccctttgtgaagcgatcagctttttatatcgtttcatttttgtatacgtcttaattgacgttgtaagtacgttttgcatacctcacattgaggatagtatcgtttcctgactaagaagttaaactagtctaccaatagcaaccatataggatatagctttgtttttaacaaggtttaatctgatcttatgctcttgcttacggtgttttatgtatagaaaagtttttataaaaactacataattgtcaaaagaaaaagcgttacgtactgacgcatttatgttcacagtgtgacacaaaccttctatattttgattgtaaaataggctttgcctgaccatttatcaaatacaaactgtttcaaacgcctctccgagccatattggccgacgcgaatcgacataacagggtgagtttacagctgcagttgcagccgaggatccacttatttgagagagaattactcttaacgaaattttgaagtcacttctacacagttaagtctgagtaggcgttatccaaacgtaaa

SEQ ID NO: 3027 - DNA, 675 bp, Picornavirales Tottori-HG1
agccatgaactagtgtgcgattcccacagtgttggtcgaaagccccgcactgtctactcgcatatttgactccagtccttccgcagccagcggttaggttctggttaaagtgcattatgtgcacggcgccacgcagaactgccagaaatggtaagctgcgcccaacgccaacggtttgtgtatcccgttagtcacacgtttacagctgttcgttaacagtagggttttgtcgacccggaccccttaatgcgcgcgaattcaaccgcgcctagtcggcaatggtatcatttaatcccatgcactacgggagaaatttgagaccaaagaattcctgagggccactgcttgctctaagtgcaatgcctcgggagacttctgtcaggagcctagcggctttcaaccgcgacagctaactcctgcgggatgtttggtgtccatacttactggcgtcctcacaacgctaagtggatgttgtccacaggtaggcaaacaccgagccccacattcaggagacctgtatgaacgatcctatcagcattagagttggaattgggtgtgctaacgtccgcataagtgcaccccgtggtaacgctgggaaactatccagcgcaacgtactgtcctcaatgtctagggaaggaccgccctaagcgtacaaccgggccatgtgtcgagc

SEQ ID NO: 3028 - DNA, 150 bp, Yokose virus
agtaaattttgcgtgctagtcgctgagcgtcagaccgcaaagtgagtttttagtgatctaaagtgaggagttattcttactgtcatcaaacactacaaataaacacgttgaaattatttccggaagaacaactgtccggaatcaaagacg

SEQ ID NO: 3029 - DNA, 675 bp, Staphylococcus phage SA5
agtacttggtattccggtacctttgtacacctatttacaaaccctaccccttgtaaccttagaagcaattatttaaccgctcactagggggtgtgctatccaagcacatcaagagcaagcacttctgtctccccgggaggggctaatggtacgctgtgcccacggcggaaatgagccctaccgttaaccggcagtctacttcgggaagcccagtaactacattgaaactttgaggcgttacactcagcacataaccccaatgtgtagttctggtcgatgagccttggcatcccccacaggcgactgtggccaaggctgcgttggcggccagcctgcggaccaaaagtccgtaggacgcctaattgtggacatggtgtgaagagcctactgagctagactgtagtcctccggcccctgaatgcggctaatcctaaccctggagcatccgcgtgcaacccagtacgtagggtgtcgtaatgcgtaagtctgggatggaaccgactactttgggtgtccgtgtttcttgtttttcatactgggtcgcttatggttacaactaattgttgtaatcattggcagtgcgcgctgaccacgcgattattgatatttccatttgttggatactccaatagtgtcaactcatatacacaacttttaccactgatcaagataaaa

SEQ ID NO: 3030 - DNA, 118 bp, Wesselsbron virus
agtatattctgcgtgctaatcgttcgacgttagtccgtggagtgagcttctattagagtcgttaacacgtttgaataatttctactgaaaggagtagaagaaaggagattcattccca

SEQ ID NO: 3031 - DNA, 104 bp, Bussuquara virus
agtatttcttctgcgtgagaccattgcgacagttcgtaccggtgagttttgacttaacgcagtgagaaaagttttcgaggaaagacgagaagcgaattctctga

SEQ ID NO: 3032 - DNA, 106 bp, Zika virus
agttgttgatctgtgtgagtcagactgcgacagttcgagtctgaagcgagagctaacaacagtatcaacaggtttaatttggatttggaaacgagagtttctggtc

SEQ ID NO: 3033 - DNA, 675 bp, Breda virus
atcacctagtacttacaagcgggtcaaaccgccctccggaacggtcataaccccctcccgaacgtgcgcttgacgtgactggtctttcagtctagctttctgagaaatactccggggttgtaacccaccattttgacctttggtcagtttggtaacactccaaccaaacagcatctgacccacctccagcttgctgcaggccatttggaccaaacgggttcagatatcttgtggctaaacctctgacccacctccagtttactgcaggccttttggactaaacgggtacagactctttgtggttagtttttaactacccactgtttagccgccaacctgatttttattgttacaaaattttgtgtttacacattattttcttacggttggcagtttgtttggttgtttgcacagtttttgctgataccaatttttactgtgcttttggtgttttcggctaaggctgtttttcacatacttagtttgcttgaagtaaccttcacaacatctgttttgtttttggtttctaaggtaaagagtttcaggaaaaaacataggcgcccatcttgtggtgtctagttttaattaatctggcaaacaagtatcaagtcatcgactccctttggagtgagacttacgagtaccaattcgcctattttggccatccatataaaa

SEQ ID NO: 3034 - DNA, 189 bp, Porcine reproductive and respiratory syndrome virus 2
atgacgtataggtgttggctctatgccttggcatttgtattgtcaggagctgtgaccattggcacagcccaaaacttgctgcacagaaacacccttctgtgatagcctccttcaggggagcttagggtttgtccctagcaccttgcttccggagttgcactgctttacggtctctccacccctttaacc

SEQ ID NO: 3035 - DNA, 312 bp, Unknown
  Description of Unknown: PV Mahoney sequence
atgagtctggacatccctcaccggtgacggtggtccaggctgcgttggcggcctacctatggctaacgccatgggacgctagttgtgaacaaggtgtgaagagcctattgagctacataagaatcctccggcccctgaatgcggctaatcccaacctcggagcaggtggtcacaaaccagtgattggcctgtcgtaacgcgcaagtccgtggcggaaccgactactttgggtgtccgtgtttccttttattttattgtggctgcttatggtgacaatcacagattgttatcataaagcgaattggattggcc

SEQ ID NO: 3036 - DNA, 675 bp, Unknown
  Description of Unknown: TRV NGS910 sequence
atgcgacgtggttggagattaaaccgactccgacgaaagtgctatcatgcctccccgattatgtgatgttttctgccctgctgggcggagcattctcgggttgatacaccttgaatccttcatccttggacctcaggtcccccggtctaagccgcttggaatacgacagggttattttccaatcttctcctttctactttcatgagtcctattcatgaaaagggtctgtgctgccccttccttcttggagaatctgcgcggcggtctttccgtctctcgaaaagcgcagatgcagcatgctggaaccggtgaagaaaacagttctttgtggaaacttagagcagacatcgaaacagctgtagtgacctcacagtagcagcggaaccccctcctggtaacaggagcctctgcggccaaaagccccgtggataagatccactgctgtgagcggtgcaaccccagcaccctggttcgatggttgttctctgtggaaccagagaatggtctttctcaagccctccagtagagaagccaagaatgtcctgaaggtaccccgcatgcgggatctgatcaggagaccaatcgtcagtgctttacactggcgctttggtttaaaaactgtcacagcttctccaaaccaagtggtcttggttttcacttttatcaaactgtttc

SEQ ID NO: 3037 - DNA, 625 bp, Unknown
  Description of Unknown: AP1.0 sequence
attctcgggctacggccctggagccactccggctcctaaagatttagaagtttgagcacacccgcccactagggccccccatccaggggggcaacgggcaagcacttctgtttccccggtatgatctgataggctgtaaccacggctgaaacagagattatcgttatccgcttcactacttcgagaagcctagtaatgatgggtgaaattgaatccgttgatccggtgtctcccccacaccagaaactcatgatgagggttgccatcccggctacggcgacgtagcgggcatccctgcgctggcatgaggcctcttaggaggacggatgatatggatcttgtcgtgaagagcctattgagctagtgtcgactcctccgcccccgtgaatgcggctaatcctaaccccggagcaggtgggtccaatccagggcctggcctgtcgtaatgcgtaagtctgggacggaaccgactactttcgggaaggcgtgtttccatttgttcattatttgtgtgtttatggtgacaactctgggtaaacgttctattgcgtttattgagagattcccaacaattgaacaaacgagaactacctgttttattaaatttacacagagaagaattaca

SEQ ID NO: 3038 - DNA, 625 bp, Unknown; identical to SEQ ID NO: 3037
  Description of Unknown: Apodemus Picornavirus 5?201 sequence

SEQ ID NO: 3039 - DNA, 277 bp, Betacoronavirus England 1
atttaagtgaatagcttggctatctcacttcccctcgttctcttgcagaactttgattttaacgaacttaaataaaagccctgttgtttagcgtattgttgcacttgtctggtgggattgtggcattaatttgcctgctcatctaggcagtggacatatgctcaacactgggtataattctaattgaatactatttttcagttagagcgtcgtgtctcttgtacgtctcggtcacaatacacggtttcgtccggtgcgtggcaattcggggcacatc

SEQ ID NO: 3040 - DNA, 488 bp, Potamipivirus A; identical to SEQ ID NO: 14

SEQ ID NO: 3041 - DNA, 675 bp, Cadicivirus B
caccaacccttgacctgtaatgtcagtggacagagtgctcctctgttcccggttaccgtgttccaggacacgattgtaatcctgcgcctcaccagcgctgcgtgcacgtctgcataaggaaacgtgccttccccatgtctctatcaattctttggtgagtgaccgccctagttgctcatcctatgggattcttctctcatgggttctttgtggcatgcgaatgtcaccttaattggaggtctttaattagatatcctttcttcatctttgatatgagtgtcggaatttgattcctagtctctgcaaaacaaccccacttgatgaattcaacttttcaaccgcacaaacataatcaggtttttaaattgaatgtttctaaattctaaatttagtttatttaagtagtttgccatcttgactcgatgtaaaattgtcatacaagtcttcttttcttttctttacactttgaagtttgcacttagcagtcgttctgcacagctttcgagttttgtttgatcgacatcgcaacttccacccacctctctttttctagtgttgaatgcggctaatcctaacccgagagcaataaacccaggtttattgtcgtaacgcgcaagtcttggacggaaccgactatacacacacctctttaccctttagtacacccttggtacg

SEQ ID NO: 3042 - DNA, 486 bp, Bovine nidovirus TCH5
caccaatagattagtcaagctgtctataggcataaactaacccccaaccccattaccccggggccaggtgggccgccgccttcgggcaaacccgtgcgctggtataatcaaggttcacagccagattcactgccggttagctagtggggcggtagcctggcaaaacccgaagaggttggaaagggaacttcagggtagtttatcctaggctagcgtagctacagttcggtcaagataaccgtcctggtgctagggctagtagagacagtggtaacttggacaagggtccagggccactttagggaataccctacggaaggctaggtccgtaaggaagacccccgcagttgtccgcggttgagcagagctcctgcgtagacaaaaggcaaaaagtggattacattcgcctgcaggaaaaggcaaacgtcgttggagtcggagctaaagtactggacgattgataccacgcctgctgcggtagataaa

SEQ ID NO: 3043 - DNA, 629 bp, Aichivirus A; identical to SEQ ID NO: 1317
  FSS693

SEQ ID NO: 3044 - DNA, 675 bp, Unknown
  Description of Unknown: EV J 1631 sequence
caccctgagggcccacgtggcgtagtactctggtatcaaggtacctttgtacgcctattttatttcccttcccccacagtaacttagaagcttatctcatagttcaacagtagggtcactaaccaagtggctcagcgaacaagcacttctgtttccccggtcctagtacctgtgaagctgtacccacggcggaaggggaaaaagatcgttatccggccccctacttcggaaagcctagtaacaccattgaagcaatcgagtgttgcgctcagcacagtaacccctgtgtagctttggttgatgagtctgggcactccccactggcgacagcggcccaggctgcgttggcggccaaccgactcgggcaaccgggtcggacgctcgtttgtggacatggtgtgaagagcctactgagctagagggtagtcctccggcccctgaatgcggataatcctaaccccggagcacccacactcaatccagagtgcaggatgtcgtaacgcgtaagtctgggacggaaccgactactttgggtgtccgtgtttcctgttttacttactttggctgcttatggtgacaatctagtgttgttaccatatagctattggattggccatccggtgttttgaattgtgtgtttatactaattcttttacatatcacagacaaccaaat

SEQ ID NO: 3045 - DNA, 270 bp, Guereza hepacivirus
cactcaatactacactccgcatttggggagaagcgctggcgttcgcggaaccgcgttaaccatacgcgtagtacgagtgcgacagaccccggtgctactggtggtagcgagacacgagccgaagtctgtggggggaactccacttagagggcatgcccgggcgtaggcttctgagttgggatgggccccaacttggcccctgagtgggggggtgttacgacctgatagggtgcgggctggcgcctaccactttccagtcgtacatgagtc

SEQ ID NO: 3046 - DNA, 721 bp, Saffold virus
cacttatttaattcggccttttgtgacaagcccctcggtgaaagaacctctctcttttcgacgtggttggaattgccatcatttccgacgaaagtgctatcatgcctccccgattatgtgatgttttctgccctgctgggcggagcattctcgggttgagaaaccttgaatctttttctttggaaccttggttcccccggtctaagccgcttggaatatgacagggttattttcttgatcttatttctacttttgcgggttctatccgtaaaaagggtacgtgctgccccttccttctctggagaattcacacggcggtctttccgtctctcaacaagtgtgaatgcagcatgccggaaacggtgaagaaaacagttttctgtggaaatttagagtgcacatcgaaacagctgtagcgacctcacagtagcagcggactcccctcttggcgacaagagcctctgcggccaaaagccccgtggataagatccactgctgtgagcggtgcaaccccagcaccctggttcgatgatcattctctatggaaccagaaaatggttttctcaagccctccggtagagaagccaagaatgtcctgaaggtaccccgcgtgcgggatctgatcaggagaccaattggcggtgctttacactgtcactttggtttaaaaattgtcacagcttctccaaaccaagtggtcttggttttccaattttgttga

SEQ ID NO: 3047 - DNA, 674 bp, Saffold virus
  3?47
cacttatttaattcggccttttgtgacaagcccctcggtgaaagaacctctctcttttcgacgtggttggaattgccatcatttccgacgaaagtgctatcatgcctccccgattatgtgatgttttctgccctgctgggcggagcattctcgggttgagaaaccttgaatctttttctttggaaccttggttcccccggtctaagccgcttggaatatgacagggttattttcttgatcttatttctacttttgcgggttctatccgtaaaaagggtacgtgctgccccttccttctctggagaattcacacggcggtctttccgtctctcaacaagtgtgaatgcagcatgccggaaacggtgaagaaaacagttttctgtggaaatttagagtgcacatcgaaacagctgtagcgacctcacagtagcagcggactcccctcttggcgacaagagcctctgcggccaaaagccccgtggataagatccactgctgtgagcggtgcaaccccagcaccctggttcgatgatcattctctatggaaccagaaaatggttttctcaagccctccggtagagaagccaagaatgtcctgaaggtaccccgcgtgcgggatctgatcaggagaccaattggcggtgctttacactgtcactttggtttaatgttga

SEQ ID NO: 3048 - DNA, 726 bp, Saffold virus
  Kozak
cacttatttaattcggccttttgtgacaagcccctcggtgaaagaacctctctcttttcgacgtggttggaattgccatcatttccgacgaaagtgctatcatgcctccccgattatgtgatgttttctgccctgctgggcggagcattctcgggttgagaaaccttgaatctttttctttggaaccttggttcccccggtctaagccgcttggaatatgacagggttattttcttgatcttatttctacttttgcgggttctatccgtaaaaagggtacgtgctgccccttccttctctggagaattcacacggcggtctttccgtctctcaacaagtgtgaatgcagcatgccggaaacggtgaagaaaacagttttctgtggaaatttagagtgcacatcgaaacagctgtagcgacctcacagtagcagcggactcccctcttggcgacaagagcctctgcggccaaaagccccgtggataagatccactgctgtgagcggtgcaaccccagcaccctggttcgatgatcattctctatggaaccagaaaatggttttctcaagccctccggtagagaagccaagaatgtcctgaaggtaccccgcgtgcgggatctgatcaggagaccaattggcggtgctttacactgtcactttggtttaaaaattgtcacagcttctccaaaccaagtggtcttggttttccaattttgttgaccgcc

SEQ ID NO: 3049 - DNA, 675 bp, Simian Sapelovirus 1
ccaaggatctgttgcataggcgttgtatcccctaaccttttacctacccatcccaataggactggtatttcggttttgattgagtaatggatactgattctatacctgttacccattcaggggaaaaatggagtttctttcatggatctgacttgatatgaccaagagtcaacactttgcgtgttggccgtatggaatgctttaaggtttattctttggattatgacttcagggttggccgcccaggataaaaggcaattgtggtaagtgatgttagtcattggtggttgaaacctgcctaagacgtcctaggtctacgctgtgcgggccgaagtaagcttaggaataacagggagtatgccattttctgctttcacccaacacgaccgtacacgaaagagctagaggcactttggggcaaagggaaaagctttgcttagcccgaatgttcatttgagtccttgacgaatgcgtcccgtctgtcccgacggtgaggcgtatggcgcatgctcatggcattacccaatggtgtatctgtgaggggggggctcctcacacttagtctagtgctacctgacagggccgcggctggtcgtttgtgtatggtataaccagtagtaatcccccatggattgctttaacttcccctcctcccttaccaagacattctctaag

SEQ ID NO: 3050 - DNA, 675 bp, Unknown
  Description of Unknown: A105-675 sequence
ccacccacagcaagaatgccatcatctgtcctcacccccatttctcccctccttcccctgcaaccattacgcttactcgcatgtgcattgagtggtgcacgtgttgaacaaacagctacactcacgtgggggcgggttttcccgcccttcggcctctcgcgaggcccacccttccccttcctcccataactacagtgctttggtaggtaagcatcctgatcccccgcggaagctgctcgcgtggcaactgtggggacccagacaggttatcaaaggcacccggtctttccgcctccaggagtatccctgctagtgaattctagtggggctctgcttggtgccaacctcccccaaatgcgcgctgcgggagtgctcttccccaactcaccctagtatcctctcatgtgtgtgcttggtcagcatatctgagacgatgttccgctgtcccagaccagtccagcaatggacgggccagtgtgcgtagtcgtcttccggcttgtccggcgcatgtttggtgaaccggtggggtaaggttggtgtgcccaacgcccgtactttggtgacaactcaagaccacccaggaatgccagggaggtaccccgcctcacggcgggatctgaccctgggctaattgtctacggtggttcttcttgcttccatttctttcttctgttc

SEQ ID NO: 3051 - DNA, 513 bp, Porcine Kobuvirus; identical to SEQ ID NO: 1446
  XX

SEQ ID NO: 3052 - DNA, 675 bp, Unknown
  Description of Unknown: Turkey Gallivirus M176 sequence
ccactcgcacttcctggatagtgcgttagatatgcccgacatatcgcttccaggaccaaagccccccttttctctttcccaaccagcttcgccactcaagctgtaattccatgtccggtctttccggccttagtatcatggaaatgtggtcgtgctcaaatgaaattgagttgacattgatcaatgaaagttgcactgaactttgctaaactggctagcgccacctggtgtgtgccgttggtctcctcacatggtaacatgtgccaacgggcccgaaaggctagtgggcaattaccgctccaagggaggggtacccaccccgacctgaacagcggtaatgaagctcacctcccaggctctgaccccgagaagtttagttatttagtaggtgtaattagtacttgtgattggtcaatttgatagtagtttgaaacgttatggatgaatgagtagaccccctgaaggtaccccattacatgggatctgatcagggccacattctgcgtgtctccccgcacttgtggttaaaaccatgaaagttcatcccaaacaatcttttcctcttctttttcttttagtggtgacaacctactggattggtgattaccaatctgtactagtgttgtattaagacttgttgtgtggagaaaatggactctttcaagaagatttttg

SEQ ID NO: 3053 - DNA, 675 bp, Unknown
  Description of Unknown: Rosavirus 2 GA7403 sequence
ccaggcatggcgttaaacatgcattcccttcccctagtaacctcccttcgccccttccccacgttgtaccccctccgagatggctgctaaggcgcttgctgctacagcagtctcgtgtttcgggtgttataagtgctttcttttccactccactccctgcctatggggagcggaacggccttgtctcggtcgttgcttcttgcagatcttcacccctccaggctttctggactcgccaggggtggagtagtaggcgcactgtctaagtgaaggtagcagtgttgttggcgaagagttgtggacctactttgagtttgtagcgatcatccagagctagcggatctccccacgcggtaacgcgtgcctctaggcccaaaaggcacggtgttcacagcaccctttggatggcgggggtgcccccctccgcacttaaagtagaaaaacagcttagtagtcaaataacatggctttcctcaagcattcagtgctacatgggactgaaggatgcccagaaggtacccgcaggcaacgataagctcactgtggatctgatctggggccctgggccaggtgctatacacctggttaaaaccaaatctggtagtcagggttaaaaaacgtctaagtcccacccccccggggacggggggttcccttaaaccctcaactgacacc

SEQ ID NO: 3054 - DNA, 293 bp, Bovine hepacivirus
ccatcgacactccaggctcacggattaagttaggttccgccgaagcgggctaaccaggcccctagtaggaggcgcctatcccgtgagccctttccccacggattgagtggagctggagctgggaaggaccgagtacggtccaatcgagaagaaccctgatgaacattccaggcctcttcggtagatttggatatatccaccagtgaaggcggggtcgtgggtacaggccccctagtccacacagcctgatagggtcctgccgcaggatccgtgggtgcggctgtacatgtacc

SEQ ID NO: 3055 - DNA, 675 bp, Unknown
  Description of Unknown: 18-675 sequence
cccacagcaagaatgccatcatctgtcctcacccccaattttcccttttcttcccctgcaaccattacgcttactcgcatgtgcattgagtggtgcatgtgttgaacaaacagctacactcacatgggggcgggttttcccgccctacggcctctcgcgaggcccaccccttccctccccttataactacagtgctttggtaggtaagcatcctgatcccccgcggaagctgctcacgtggcaactgtggggacccagacaggttatcaaaggcacccggtctttccgccttcaggagtatccctactagtgaattctagcggggctctgcttggtgccaacctcccccaaatgcgcgctgcgggagtgctcttccccaactcaccctagtatcctctcatgtgtgtgcttggtcagcatatctgagacgatgttccgctgtcccagaccagtccagtaatggacgggccagtgcgtgtagtcgtcttccggcttgtccggggcatgtttggtgaaccggtggggtaaggttggtgtgcccaacgcccgtactttggtgacacctcaagaccacccaggaatgccagggaggtaccccacctcacggtgggatctgaccctgggctaattgtctacggtggttcttcttgcttccacttctttcttctgttcacg

SEQ ID NO: 3056 - DNA, 562 bp, Encephalomyocarditis virus
  pEC9
ccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataat

SEQ ID NO: 3057 - DNA, 654 bp, Mosavirus A2
  SZAL6
cccccccctcaaattgcaacgatatagctaatggcgagattgagatgctatatcacctcttctaagttatagacctcatctgattgataaggacgtaatttggtcgaaaccgcttggaataagaccgatgcgcgtagtcatgatgatgatgtaagatctaggaacttatccaatctgcttatgtctatgtaagtagaggggcaggcctcattgccctaattctttctaccgagtatctgctagggtttctagcggcttgaatacttggattgagggatacaagatactactgatcgattgtcgattgggaaacttgtagatacttcaaagctaccagtagcgtggactcacagccagcggactacccctcatggtaacatgagcctctgggcccacaaggcacgtcgcaagacctgtgagacggcaaccccagcctagctttgttgaggaaacaagcgataacatgacatgagagaccggaaggattcttgtattgtgagccgaaggatggcctctaggtacctcattttatgagatctgaggaggtgctcttgagttggtgctttacactgacaacacagagttaaaaagcgtctaagctcacccggaaattgggaaatttccgttatttccattttgtttgcaaagtcgttc

SEQ ID NO: 3058 - DNA, 608 bp, Bourbon virus
ccccccctacttaaagatgtacggttttgctgctttcacagagtaaagcagatagaggttctgaactggcaaactttacctcgaaacacgcccgtttttctgctgtgtctcacagactgtcctgtcacacttgtggcggcttgtgacactgtgaacatagtgagaccgaccaagacaacagtttcaagtgatgaacatcgaacgtctaaactggatccgtaactggacatgttagggcaaggacttcccccctggtaacaggagcctggctggccaaaagccccgctcattgagcctagcatgttgtcgaccctggactgttcagtttagttagtacatggaattcacttgtcacggttcttctgaactcggtctctagtatgacagcctaaggatgccctccaggtaccccggggtaacaagtgacacccgggatctgaggaggggactactttacgtagtttaaaaaacgtctaagctgttatggtgaccagaggctggcacctttcacttttaaaattacactactgactacaattgaagtgataacggttttacaggctttcaaactagttacacaagcactgttttcctgacacacacacttt

SEQ ID NO: 3059 - DNA, 585 bp, Encephalomyocarditis virus
  A
cccccctctccctccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggccacaacc

SEQ ID NO: 3060 - DNA, 457 bp, Crohivirus B
  5?51
ccccccttttccccagccatgggttaaatggcaataaaggacgtaacaactttgtaaccattaagctttgtaattttgtaaccactaagctttgtgcacataatgtaaccatcaagcttgttagtcccagcaggaggtttgcatgcttgtagccgaaatggggctcgaccccccatagtaggatacttgattttgcattccattgtggacctgcaaactctacacatagaggctttgtcttgcatctaaacacctgagtacagtgtgtacctagaccctatagtacgggaggaccgtttgtttcctcaataaccctacataataggctaggtgggcatgcccaatttgcaagatcccagactgggggtcggtctgggcagggttagatccctgttagctactgcctgatagggtggtgctcaaccatgtgtagtttaaattgagctgttcatatacc

SEQ ID NO: 3061 - DNA, 436 bp, Unknown
  Description of Unknown: GB virus C/Hepatitis G virus sequence
cccccggcactgggtgcaagccccagaaaccgacgcctatctaagtagacgcaatgactcggcgccgactcggcgaccggccaaaaggtggtggatgggtgatgacagggttggtaggtcgtaaatcccggtcaccttggtagccactataggtgggtcttaagagaaggttaagattcctcttgtgcctgcggcgagaccgcgcacggtccacaggtgttggccctaccggtgggaataagggcccgacgtcaggctcgtcgttaaaccgagcccgttacccacctgggcaaacgacgcccacgtacggtccacgtcgcccttcaatgtctctcttgaccaataggcgtagccggcgagttgacaaggaccagtgggggccgggggcttggagagggactccaagtcccgcccttcccggtgggccgggaaatgc

SEQ ID NO: 3062 - DNA, 655 bp, Caprine kobuvirus
  d20
ccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 3063 - DNA, 604 bp, Acute bee paralysis virus
cccgtcaaaataacaacttataacacgatgttacccgaagaaaccattttagtgtaacatttaagattagaagtagttcatctaatagagataggcactattagaaggaggccttttctaaaggagccgttagtcagcccagacaagcgcagtactttagaagagagaagttccccgatagcgaccgaaaagacgcgttttccgtgctaactaatttaaatgtgggaacgaatattattattgaaattatgtgagccacgtagcaatcaagtcatgtttttgtcactacgtttactcatctaatgtagataattttgtttaagtacctatttaggtgtcatcccaccagagaagaaataatacgtaccggaacccagagtacaccccttattttaagccttactgggcttctctgttagttagtaatctggcccacgttttgcgttgagtggggtcccaacagtaggaattcgacggacaagtagcaagcgagtcggtaccaattggtttagccttcgaaattactctgggcaggaagttactaaacgagaactttctgcttaaatcccaacgcacaaacaaatagagtaaataaataattata

SEQ ID NO: 3064 - DNA, 675 bp, Niviventer confucianus picornavirus
ccctttcataaccccccccttttaacccaacccttcgtaaccgtacgcttcactcgcctttgggtatagcggcccaatgtgctgaagaaaaggatacgctataaggggccaacgggtggtggcccttaagaccacccaacctagaagcttgtacactcgggcaatagtgaggcccacatccagtgggtcaagcccaaagcattcttgttccccggtatgatctcataagctgtacccacggctgaaagagtgattatcgttatcccactcagtacttcggagagcctagtacaccacttggaaatggaagtctgtgatccggggttgaccctgaaccccagaaactcatgatgaggctaaccttcccgaacacggcgacgtgtggttagcctgcgctggcatgaggcctctttgtaggcagactgaaatggaagggtgacgaagagccgactgagctactgttttattcctccggccccctgaatgcggctaatcctaactcctggtccagtacttgtaacccaacaggtggctggtcgtaatgcgtaagccgggagcggaaccgactactttggggcgtccgtgtttctcaatattattcatttctagcttatggtgacaatttatgattgcagagattgtgctgtatttgtgtctgagagaagaagtaacaat

SEQ ID NO: 3065 - DNA, 551 bp, Rabovirus A
  NYC-B10
ccgaccccactggtcgaaggccacttggcaataagactggtggaacaaggtcgcctgtagttgattggaaccttctttctaatgacttatgtcagcggtgctactcacaccgtaactctcctaccctatccccacgcttgtggaactaggaggggatgagtgattcaagtaagtactgtcagaatggtgaaaataatctgattctgaaacgctatggatccatcgaaagatggggctacacgcctgcggaacaacacatggtaacatgtgccccaggggccgaaagccacggtgataggatcacccgtgtagtttgagatcatatcaatgttcatagtctagtaagatgatttgaaatctaactggtctgatggctaactgcttgtcttattgcggcctaaggatgtcctgcaggtacctttagagaaccttaagagactattgatctgagcaggagccaaggtggtctttcccagccttggttaaaaagcgtctaagccgcggcagggggcgggaggccccctttcctcccaaactataatatagattgt

SEQ ID NO: 3066 - DNA, 625 bp, Caprine kobuvirus
  d50
ccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 3067 - DNA, 675 bp, Cosavirus A
  SH1
ccgtgctttacacggtttttgaaccccacaccggctgtttggcgcttgcaggacagcaggtttattttcttatgctctttatttctagccaacagggttctatcctgttgggcggagtgatactcccgttccttcttggacagattgcctccacgatctttgtggatctcaaggtgatcaagtcactggtaaatagagcgaaggttgaggaaacctgaggaatttccatgtggttttgccaggagttgtagcgatgctgtgtgtgtgtgcggatttcccctcatggcaacatgagcctcacaggccaaaagccctgtccgaaaggacccacacagtggagcaatcccagctccctcctacaaagctttgtgagaatgaactcacgtttattcttctttattctctgtttacatcaggccccaaagatgtcctgaaggtaccttgtgtatctgggcatgagcaccatcaactacccggacttgcatttcggtgcagacacatgtggttacccagcccctctgctttggcagaggggcttttgctcgctcagcacgagatctgatcaggagcccttcccagtgtgctttacacctggcggggggttaaaaattgcccaaggcctggcaaaataacctaggggactaggttttccttttattaacaatgtctgtcatt

SEQ ID NO: 3068 - DNA, 675 bp, Unknown
  Description of Unknown: Kobuvirus SZAL6 sequence
cctacccaagggttacatgggaccatattcctcctcccctgtaactttaagttttgtgcccgtattcttgactccaggcggatgttgtgtcgcccgtcctgtgaacaaacagctagacactttcctcccctccctctgggctgctccggcagtccactccctccccccagcgtaacatgccccgctggagtgatgcacctggaagtcgtggacgtgggttagtaacttcggtgaaaacccactataatgacaactggttgacccccacactcaaaggactcgagtctttctcccttaaggctagcccggccacatgaatttgcagctggcaactagtgagtccaccatgtcccgcaacctcggctgcggagtgctgttccccaagcgtatgccttccttctgtaagagtgcgcctggcaagcacatctgagaagtcgttccgctgcgtcgtgccaacctggcgacaggtgacccagtgtgcgtagacttcttccggattcgtccggctcttctctaggaaacatgcgtgtaaggttcatgtgccaaagccctgcgcgcggtgttcttctactgccctaggaatgtgccgcaggtacccctacttcggtagggatctgagcggtagctaattgtctacgggtagtttcatttccatcttctcttcaggtcgacatc

SEQ ID NO: 3069 - DNA, 636 bp, Unknown; identical to SEQ ID NO: 67
  Description of Unknown: Oscivirus sequence

SEQ ID NO: 3070 - DNA, 675 bp, Saffold virus
  5?46
cctctctcttttcgacgtggttggaattgccatcatttccgacgaaagtgctatcatgcctccccgattatgtgatgttttctgccctgctgggcggagcattctcgggttgagaaaccttgaatctttttctttggaaccttggttcccccggtctaagccgcttggaatatgacagggttattttcttgatcttatttctacttttgcgggttctatccgtaaaaagggtacgtgctgccccttccttctctggagaattcacacggcggtctttccgtctctcaacaagtgtgaatgcagcatgccggaaacggtgaagaaaacagttttctgtggaaatttagagtgcacatcgaaacagctgtagcgacctcacagtagcagcggactcccctcttggcgacaagagcctctgcggccaaaagccccgtggataagatccactgctgtgagcggtgcaaccccagcaccctggttcgatgatcattctctatggaaccagaaaatggttttctcaagccctccggtagagaagccaagaatgtcctgaaggtaccccgcgtgcgggatctgatcaggagaccaattggcggtgctttacactgtcactttggtttaaaaattgtcacagcttctccaaaccaagtggtcttggttttccaattttgttga

SEQ ID NO: 3071 - DNA, 675 bp, Unknown
  Description of Unknown: EV22 sequence
ccttataacccgacttgctgagcttctataggaaaaaaccctttcccagccttggggtggctggtcaataaaaacccccatagtaaccaacacctaagacaatttgatcaaccctatgcctggtccccactattcgaaggcaacttgcaataagaagagtggaacaaggatgcttaaagcatagtgtaaatgatcttttctaacctgtattatgtacagggtggcagatggcgtgccataaatctattagtgggataccacgcttgtggaccttatgcccacacagccatcctctagtaagtttgtaaaatgtctggtgagatgtgggaacttattggaaacaacaatttgcttaatagcatcctagtgccagcggaacaacatctggtaacagatgcctctggggccaaaagccaaggtttgacagacccattaggattggtttcaaaacctgaattgttgtggaagatattcagtacctatcaatctggtagtggtgcaaacactagttgtaaggcccacgaaggatgcccagaaggtacccgcaggtaacaagagacactgtggatctgatctggggccaactacctctatcaggtgagttagttaaaaaacgtctagtgggccaaacccaggggggatccctggtttccttttattgttaatattgacatt

SEQ ID NO: 3072 - DNA, 675 bp, Coxsackievirus B5
cctttgtgcgcctgttttatgcccccttcccccaattgaaacttagaagttacacacaccgatcaacagcgggcgtggcataccagccgcgtcttgatcaagcactcctgtttccccggaccgagtatcaatagactgctcacgcggttgaaggagaaaacgttcgttacccggctaactacttcgagaaacctagtagcatcatgaaagttgcgaagcgtttcgctcagcacatccccagtgtagatcaggtcgatgagtcaccgcattccccacgggcgaccgtggcggtggctgcgttggcggcctgcctacggggcaacccgtaggacgcttcaatacagacatggtgcgaagagtcgattgagctagttagtagtcctccggcccctgaatccggctaatcctaactgcggagcacataccctcaacccagggggcattgtgtcgtaacgggtaactctgcagcggaaccgactactttgggtgtccgtgtttccttttattcttataatggctgcttatggtgacaattgaaagattgttaccatatagctattggattggccatccggtgtctaacagagctattatatacctctttgttggatttgtaccacttgatctaaaggaagtcaagacactacaattcatcatacaattgaacacagcaaa

SEQ ID NO: 3073 - DNA, 675 bp, Unknown
  Description of Unknown: Icavirus sequence
cgaagtttaagctaagcaccctcgggcgttcccggattatgtgatcacatcaatttgatggctggtcaccacgcaacgcctggagagatactcttacttttctcttaagatccccggtcatttgacgcttgtaggatgatagggttattttccactataaatactttcatactcttggatgttctatatccaagacgggaggacctaccccgtaccccttagaggtgagatgccaagaacaggccctttctgttctctcgacaatggcatcataggcaacaagcatcacaccaagattgctaagttttgttaagagttcttcaagctatagggtggctgtagcgaccttctgatgcctgcggatttccccacggagcgatccgtgccacaggggccaaaagccacggctaacgcccatcaggagcggcacttaccccgtgccccacccttgaaacttgaatgttcacactggcttctctcggctttctgaactgtctgcttgttggggccccgaaggatgccctggaggtaccccattttatgggatctgaccaggggacacctcagctctctaagttgctggtgtttaaaaaacgtctaagggcccccaccccttaggtggagggatccacctttcctttattttttaaaactcttttatggtcacaattgttt

SEQ ID NO: 3074 - DNA, 675 bp, Equine rhinitis B virus 1
cgacaggcacaggtcgctccgagttctagtagtgtgggaacttgttactactgatgaaacgaggtagtgacactcagtacctgcgaacgaggtcggggccctcccttcttccttcacccaactttcacttttcgttccactttagcaggggtcttctttctatccccctggcggcattggaactagccgtcgcgtcttaacgcgcagccctgaaggccccacaccttgtggatcttgccgtgggtatgtttctggcatgtgtttctcaagcctgcaaccgaagccgaacagccacatgaacagtttgagcgtggtagcgctgtgtgagttggcggtggatccccctcgtggtaacacgagcccccgtggccaaaagcccagtgtttacagcacctctcacatccaggacgaccccatcctggcgctcactcttagtagtatggcttagtacgcattaggtggtaagccgagctctccctcggccttgttctgaatgcacacatgtctaggggctaaggatgtcctacaggtacccgcacgtaaccttcagagagtgcggatctgagtaggagaccgtggtgcactgctttacagatgcagcccggtttaaaaagcgtctatgcccctacagggtagcggtgggccgcgccctttccttttaaaactacttgttct

SEQ ID NO: 3075 - DNA, 675 bp, Unknown
  Description of Unknown: HAV HM175 sequence
cgccgtttgcctaggctataggctaaattttccctttcccttttccctttcctattccctttgttttgcttgtaaatattgatttgtaaatattgattcctgcaggttcagggttcttaaatctgtttctctataagaacactcatttcacgctttctgtcttctttcttccagggctctccccttgccctaggctctggccgttgcgcccggcggggtcaactccatgattagcatggagctgtaggagtctaaattggggacacagatgtttggaacgtcaccttgcagtgttaacttggctttcatgaatctctttgatcttccacaaggggtaggctacgggtgaaacctcttaggctaatacttctatgaagagatgccttggatagggtaacagcggcggatattggtgagttgttaagacaaaaaccattcaacgccggaggactgactctcatccagtggatgcattgagtggattgactgtcggggctgtctttaggcttaattccagacctctctgtgcttggggcaaacatcatttggccttaaatgggattctgtgagaggggatccctccattgccagctggactgttctttggggccttatgtggtgtttgccgctgaggtactcaggggcatttaggtttttcctcattcttaaataata

SEQ ID NO: 3076 - DNA, 675 bp, Canine picodicistrovirus
  strain 209
cgctctttatacaaatctgtcaaccctttgtataactctaagccgaacaattatagctaggctttttattatataacattaattaggcattagcgttgtcgccaatctcttggtaatcctaaggatacctttcctgttgactaagatgaagcgccttcggttaccgatgcccggtgtccacgaagccatcgtggtcggccgcgtcccccacctctcccaacttggactccatgttttcagtaggtgtaatgattagtattattgattctgctcgttcaatgtgtttatcttcacgatctgggacccaacacatgcttcactcatgtttaaatgttggttccctcattttgaagacacccaaaccatagagtgcgagaatgaggatttctacttccattctggtaacagaaatgaattcctgcgtgtgtctcgtaaatggaatctttaagaacttcagataaatcgaacaatacactaatacaagttgttttctaccaacatgttcaatgcggctaatctgaccgtggagctgtgaagcgctcaaacccgagtgttgtatacagtcgtaatgcgtaagtccatgaggaaccgactactgttacctctgttggtgtgtttctcctttcctctcttttattattatttgttattgcaaatactacaactttgatcaac

SEQ ID NO: 3077 - DNA, 675 bp, Falcon picornavirus
cgcttggaataagttgagaggaattatgcatgctagttgtgtttgtttacaactaattgttctaatccaagtgaagctcttcgcttggggcggcacgacacttgccgtaattcttctaccgtccctccacaccttgtggatgaagggccggatgtgtggcctctggctaacccctctctctggggtgatgctactggatgttttactcctagaccaaatcacatgaactcctcttgatccacttcggtggggctatgagcctgcggattaatagctggcgacagctaccccaggggccaaaagccacggtgttagcagcaccctcatagtctgatgcccaagggctgatgttgggagctagtagtgtgtgtctggcctatgtttaggacttctggccaagcgcagaggagtggggctgaaggatgcccagaaggtacccgtaggtaaccttaagagactatggatctgatctggggccccctcacgtggctttaccacgtgttgggggttaaaaaacgtctaggccccaccagcccacgggagtgggctttcccttaaaaagcccaacaatatttatggtgacaattcactgtttcttctttgcaatttttgtattcttggactccttattttttgtttgcttgattttagtggacattcagattcaaatacaaa

SEQ ID NO: 3078 - DNA, 245 bp, Wobbly possum disease virus
cggctgtgagtgcttagcatatgctagagtactacagccgggtgttggagtcatatgcactggttgcctgtataatagtcgggatctgtctgacctacattatctttgggagttgcttatcacgacaattctcgaagtgtctgtcgacagcttacccccgattcgacaaggccccttgtccaccgcagacctatcgattttcaacgagaacactatcagaggtttaaatttaaaactcaccaaca

SEQ ID NO: 3079 - DNA, 675 bp, Unknown
  Description of Unknown: EV J N125 sequence
cggtacctttgtacgcctattttacccccttccccttgtaacttagaagcaaagcaaaccagttcaatagtaagcaacacaacccagtgttgtgacgaacaagtacttctgtttccccgggagggtctgacggtaagctgtacccacggctgaagtatgacctaccgttaaccggctacctacttcgagaagtctagtaataccattgaagttttgttggcgttacgctcaacacactaccccgtgtgtagttttggctgatgagtcacggcattccccacgggcgaccgtggccgtggctgcgttgcggccaaccaaggggcgcaagctccttggacgtcacttaacagacatggtgtgaagaacctattgagctaggtagtagtcctccggcccctgaatgcggctaatcctaactccggagcacatcagtgcaacccagcatttggtgtgttgtaatacgcaagtctggagcggaaccgactactttgggtgtccgtgtttcctgttttaccttatttggctgcttatggtgacaatttgatattgttaccatatagctgttggattggccatccggatttttgaaagagacccaaaactttcttctctacttcagattcaagtgcgaagttttccttttcatatattacttactaatttgaagtaccaaag

SEQ ID NO: 3080 - DNA, 675 bp, Parechovirus C
cggtcatccccctttccccacagccggtgtgggttctaatcggctcctactaaacacctaagcatcactgcgcctctatctctcctatccacaggtctaagacgcttggaataagacatgtgggtgcaataggaagattagctagtccaatctctccttccagctacgcttctcccttcgatgagcgtagggggggcccccacctccctcatctctggatagggctcttgctacggggctttcccgtctggaccagcaggcccactggtgcgcttccattcaagtttagtgtgcattactgtctgaaatattgctttgctaggatctagtgtagcgacctgcatattgccagcggacttccccacatggtaacatgtgcctctgggcccaaaaggcatgtctttgaccgtatgcagtacaaccccagtataggtcctttctatggcagtatggatctcagtgatgagtctatacagaatatggaagtggttcggatatgtcagcccgaaggatgcccagaaggtacccgcagataaccttaagagactgtggatctgatctggggcccaccaccttcgggtgggtagaagctaaccatgccttgggttaaaaaacgtctaagggctgaccagacccgggggatccgggttttccctatcttgacctactctaatc

SEQ ID NO: 3081 - DNA, 675 bp, Cosavirus B1
cgtgctttacacggtttttgaaccccacaccggctgtttggcgcttgcaggacagcaggtttattttcttttaactctctctttctagccacacacgatctatgtgtgtgggcggagtgatactcccgttccttcttggacaggcggcctccacgccctttgtggatcttaaggctaccaagtcactggtgttggaaagtgaagagaaaggagttccttgggaactacatgtggcattgacagaggttgtagcgatgctgtgtgtgtgtgcggattacccccgtggcgacacggaccccacaggccaaaagccctgtccgaaaggacccacacagtggagcaaccccagctcccctcttcaatgttttgtgttagcaaccttggtattattttctctcaagcttccaatacaccgggccccaaagatgtcctgaaggtaccccgtgtatctgaggatgagcaccatcaactacccggacttgttctttcgagaacagacgcatgtggtaacccagccccgatcctaaggggtcggggcttttgctcactcagcacaggatctgatcaggagacctcccccccctgctttacagggggcgggggtttaaaaattgcccaaggcctggcaaataacctaggggactaggttttcctttttattttaaagttgtcaat

SEQ ID NO: 3082 - DNA, 675 bp, Cosavirus D1
cgtgctttacacggtttttgaaccccacaccggctgtttggcgcttgcaggacagtaggtatattttctttcatttctcttttctagccgcgtaggttctatctacgcgggcggagtgatactcccgctccttcttggacaggcggcctccacgctctttgtggatcttaaggctgccaagtcactggtgtttgaagtgaagaatggagagacactagggcgtttcatgtggctttgccagggattgtagcgatgctgtgtgtgtgtgcggatttcccctcgtggcgacacgagcctcacaggccaaaagccctgtccgaaaggacccacacagtggggttgccccgacccctcccttcaaagctttgtgtaaacaaacttttgtttagactttcttaagcttctctcacatcaggccccaaagatgtcctgaaggtaccctgtgtatctgaggatgagcaccaccaactacccggacttgtgggacgtgtcccacagacgcatgtggtattccagccccctccttttgaggagggggcttttgctcgctcagcacaggatctgatcaggagattcatctctggtgctttacaccagagcatggatttaaaaattgcccaaggcctggcaaacaacctaggggactaggttttctctattttaaaagatgtcaat

SEQ ID NO: 3083 - DNA, 675 bp, Unknown
  Description of Unknown: EV D94 sequence
cgtggcggccagtactctggtatcacggtacctttgtacgcctgttttatatccccttcccccgcaacttagaagaaaacaaatcaagttcactaggagggggtacaaaccagtaccaccacgaacaagcacttctgtttccccggtgatgtcgtatagactgtaaccacggttgaaaacgattgatccgttatccgctcttgtacttcgaaaagcccagtatcaccttggaatcttcgatgcgttgcgctcagcactcaaccccagagtgtagcttaggtcgatgagtctggacactcctcaccggcgacggtggtccaggctgcgttggcggcctacctgtggtccaaagccacaggacgctagttgtgaacaaggtgtgaagagcctattgagctacaagagaatcctccggcccctgaatgcggctaatcctaaccacggagcaagggtacacaaaccagtgtatatcttgtcgtaacgcgcaagtctgtggcggaaccgactactttgggtgtccgtgtttccttttgtttttatcatggctgcttatggtgacaatctaagattgttatcatatagctgttggattggccatccggtaatttattgagatttgagcatttgcttgtttcttcaacaatttcacctattcattgcatttcagcagtcaaa

SEQ ID NO: 3084 - DNA, 675 bp, Rabovirus A
ctacggatatttgcatgacccgctttctatcgccccaacaatcccctttgtaaccacaagctttactcaggctagcagcccgactagctgtttggaagaaaaggctagggcacacaccaacaacaccgaccccactggtcgaaggccgcttggcaataagactggtggaacagggtcgcctgtagttgtttggaacattctttctaatgactttgtcagcggtgctactcacaccgtaactcttctaccctatccccacgcttgtggaactaggaggggatgagtgattcaagtaagtactgtcagaatggtgaaaatgatctgattctgaaacgctatggatccatcgaaagatggggctacacgcctgcggaacaacacatggtaacatgtgccccaggggccgaaagccacggtgataggatcacccgtgtagtttgagatcatatcaatgttcatagtctagtaagatgatttgaaatctaactgagctgatggctaactgcttgtcttattgcggcctaaggatgtcctgcaggtacctttagataaccttaagagactattgatctgagcaggagccaaagtggtctttcccagctttggttaaaaaacgtctaagccgcggcagggggcgggaggccccctttcctcccaaaacttaatattgattgt

SEQ ID NO: 3085 - DNA, 113 bp, Antarctic penguin virus A
ctaggagactacgcagtgggataagatgactatgatgtcgtacgggcagaagccagtacagtcgaagtcgagaccgacgtcgaggatttgactctgcctgacctagtgccatc

SEQ ID NO: 3086 - DNA, 675 bp, Ljungan virus 87-012
ctcattgcccacacctggttggttcccaggttcatacaataaccatcaataaacttttaacatctaagatagtattatcccatactagactggacgaagccgcttggaataagtctagtcttatcttgtatgtgtcctgcactgaacttgtttctgtctctggagtgctctacacttcagtaggggctgtacccgggcggtcccactcttcacaggaatctgcacaggtggctttcacctctggacagtgcattccacacccgctccacggtagaagatgatgtgtgtctttgcttgtgaaaagcttgtgaaaatcgtgtgtaggcgtagcggctacttgagtgccagcggattacccctagtggtaacactagcctctgggcccaaaaggcatgtcatttgaccactcaggtacacaaccccagtgatgcacacgcttagtaatggcttagtaacaaacattgattgatcatttgaaagctgttaggaggtttaggtatgacgggctgaaggatgccctgaaggtacccataggtaaccttaagcgactatggatctgatcaggggcccaccatgtaacacatgggtagaagtcttcggaccttgggttaaaaaacgtctaggcccgccccccacagggatgtggggtttcccttataaccccaatattgtata

SEQ ID NO: 3087 - DNA, 568 bp, Encephalomyocarditis virus
  B
ctccccctccccccccttactatactggccgaagccacttggaataaggccggtgtgcgtttgtctacatgctattttctaccgcattaccgtcttatggtaatgtgagggtccagaacctgaccctgtcttcttgacgaacactcctaggggtctttcccctctcgacaaaggagtgtaaggtctgttgaatgtcgtgaaggaagcagttcctctggaagcttcttaaagacaaacaacgtctgtagcgaccctttgcaggcagcggaaccccccacctggtgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacgtgctttacacgtgttgagtcgaggtgaaaaaacgtctaggccccccgaaccacggggacgtggttttcctttgaaaaccacgattacaat

SEQ ID NO: 3088 - DNA, 675 bp, Yak enterovirus
ctccggcacagccgcaccagtgcactggtacgctagtaccttttcacggggtagtcggtatccccccccgtaacttagaagcatgtaacaaaccgaccaataggtgcgcggcagccagctgcgttgcggtcaagcacttctgtctccccggtccgcaaggatcgttacccgcccactccactacgaggagcctagtaactggccaagtgattgcggagttgcgttcagccacaaccccagtggtagctctggaagatggggctcgcacatcccccgtggtaacacggttgcttgcccgcgtgtgcttccgggttcagtctccgactgttcacttcaacatcacgcaaccagccaagagccgattgtgctggagtggtcttcctccggggccgtgaatgctgctaatcctaacctccgagcgtgtgcgcacaatccagtgttgctacgtcgtaacgcgtaagttggaggcggaacagactactttcggcaccccgtgtttcctttattttattcttattttatggtgacaattgcagagatttgtgatattgcgactttaccgttaaacatagcactgcattacctggttgcattccacaaaacttcagagattcctagttcctacattgacctacttgtttatttgaatcttaaatacaaacttgagcaagtgaa

SEQ ID NO: 3089 - DNA, 645 bp, Caprine Kobuvirus
  d30
ctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 3090 - DNA, 654 bp, Seneca valley virus
ctgggccctcatgcccagtccttcctttccccttccggggggtaaaccggctgtgtttgctagaggcacagaggagcaacatccaacctgcttttgtggggaacggtgcggctccaattcctgcgtcgccaaaggtgttagcgcacccaaacggcgcatctaccaatgctattggtgtggtctgcgagttctagcctactcgtttctcccctatccactcactcacgcacaaaaagtgtgctgtaattacaagatttagccctcgcacgagatgtgcgataaccgcaagattgactcaagcgcggaaagcgctgtaaccacatgctgttagtcccttcatggctgcgagatggctatccacctcggatcactgaactggagctcgaccctccttagtaagggaaccgagaggccttcttgcaacaagctccgacacagagtccacgtgattgctaccaccatgagtacatggttctcccctctcgacccaggacttctttttgaatatccacggctcgatccagagggtggggcatgatccccctagcatagcgagctacagcgggaactgtagctaggccttagcgtgccttggatactgcctgatagggcgacggcctagtcgtgtcggttctataggtagcacatacaaat

SEQ ID NO: 3091 - DNA, 410 bp, Shingleback nidovirus 1
ctgtgagtaccgacaggctcgaagtctattatgaggcgtcgaaacagaaaacctgtaacaactccggtttcatctatcactgccgtcaagaggcagaagaggacgaccacgtgtcaccagatcacttgtatctgtttcagtcaggaagtcaacttttcgacgaagttcgaccattcatcgacccgctgaaaagcgtagaagtcgatgaagatgagctccaaagagccatcgccgatttcgacaaccaaagtgactgtttccactccttcgagctcgtgaatttcgagctgaaacaacaaatcaacgagaacgagtggtacggttattataattacgacaaccaaaactgcaaagttcagttgccagtcacatgtcgaatcgaggacgtaacctgggatcaggtttacgtg

SEQ ID NO: 3092 - DNA, 291 bp, Camel alphacoronavirus
cttaagtgtcttatctatctatagatagaaaagtcgctttttagactttgtgtctactcttctcaactaaacgaaatttttgctacggccggcatctctgatgctggagtcgtggcgtaattgaaatttcatttgggttgcaacagtttggaaataagtgctgtgcgtcctagtctaagggttctgtgttctgtcacgggattccattctacaaacgccttactcgaggttctgtctcgtgtttgtgtggaagcaaagttctgtctttgtggaaaccagtaactgttccta

SEQ ID NO: 3093 - DNA, 675 bp, Unknown
  Description of Unknown: HAV FH1 sequence
cttgatacctcaccgccgtttgcctaggctataggctaaatttccctttccctgtcctttccctatttccttttgttttgtttgtaaatattaattcctgcaggttcagggttctttaatctgtttctctataagaacactcaattttcacgctttctgtctcctttcttccagggctctccccttgccctaggctctggccgttgcgcccggcggggtcaactccatgattagcatggagctgtaggagtctaaattggggacgcagatgtttgggacgtcgccttgcagtgttaacttggctttcatgaacctctttgatcttccacaaggggtaggctacgggtgaaacctcttaggctaatacttctatgaagagatgccttggatagggtaacagcggcggatattggtgagttgttaagacaaaaaccattcaacgccgaaggactggctctcatccagtggatgcattgagggaattgattgtcagggctgtctctaggtttaatctcagacctctctgtgcttagggcaaacactatttggccttaaatgggatcctgtgagagggggtccctccattgacagctggactgttctttggggccttatgtggtgtttgcctctgaggtactcaggggcatttaggtttttcctcattcttaaacaata

SEQ ID NO: 3094 - DNA, 675 bp, Unknown
  Description of Unknown: Halastavi arva (1x mut) sequence
cttgattctaaccttgccgtatggtgccctaacgggttcatttaatcatgcgatgagggttgctataccgcatccattctaaggcgattcaatgcttcatttaggaattttgttgacgattaaaaggtacccccacaaaaacaaaaccaatcttacttgattttcgttttaactgaccactgcgatcccaaattttcgccttcttatcaaagtatgttgtgttctttgggtgtacaacctgagaacttgtctacaactacatattactcgaggaagaaattcggtttaagccgtgccttctcacgtttagtatatctatctggacacaccttcttcatcttctaatccccatctagtctcctgatcagagacgtcgttattaacaaataaccccccttgttaataagagacaaagtacaatcaagctaagttctcttggagttcctgtaggaacttagccattgtgatagagtcataagtctatgtgcatagacagctctagctcaccatttccttcccaacccatcttttcatcagcttaactctatgaatccgatgcaaaaaccattctaacatcttatggtgctttccaagccaaatgagagctcactcttttgagccgctatttaatggacaataaacgttttatagtgtacatcatattgtaaaaacaaa

SEQ ID NO: 3095 - DNA, 660 bp, Malagasivirus B
ctttattttcttatgtaactcttctttttaagttttattttgcctacttgtgagcttatgcgggaccactgtcttagacaaccccacatttgtcatgagtaagtacacgcaaccattacgattactttttaaccgtctgaccttttgataacaactgaagttaggcgtgaaacatgcatttataccaaagtagccccgcatttccccactacggtgggggggctaccctactggctttggaactgtagccattatgtgttgcctggctttcaggatctcacaacacaacagttctctcacaatggaatatgggtgagattgcagtgacatgaacaagtatctagtagtacatagactcaagcctagttgcctgcggaacaacatgtggtaacacatgccccagggtccaaaagacaagggttaacagccccttctaggtgtctgtgtgtgaagaatactttagtagtgttgttatgatctcacctgttagtacagaatgagtatggcttggtgaaggatgtcctacaggtacccattatatggatctgagtaggagaccactagtggtggctttaccgccaggtgagtggtttaaaaagcgtctagccaagccaacagcactagggatagtgctttctatattttatattttcagtgtat

SEQ ID NO: 3096 - DNA, 675 bp, Hepatovirus D
ctttggatgcccatagtgcgggggtataaataccgcactccctttagctgttccgagggtatcggaacctatatgtttgttttctgtctgtctgtcagctttatgtgtgctcgtcccctttagggcactcatttcagcttgctttcattcttttcttccccggttctcaccttaccggaggcactggccgttgcgcccggcggggtcaacctagtgattagcactaggctgtaggtgtctaaagtggtgacattaagacttggtaactgatttcagcactgttaactgatgttggggatgacttgattgatcttctggaaggggtaggctacgggtgaaaccccttatcttaataccactatgtagagatagattcagtaggttaagggcagtggataaggttgagttcattttggacaataaaccttcaacactggtggacccaatctcactgaccagatgctttcttgactgatccttcagaggggtgattcttctgaataggttgccttgacactgatgcctgagacccattgggtcgggccttaaatcatggaactccactggactttcatggcctagcttctgccttagacagactctggggccccacgaccctctgggcccttcggggtactcaggggcatttaggtttttccacaattaaaagagtta

SEQ ID NO: 3097 - DNA, 675 bp, Unknown
  Description of Unknown: EV C102 sequence
ctttgtacgcctgttttacatcccctcccccacgtaactttagaagcaattcaacaagttcaatagagggggtacaaaccagtatcaccacgaacaagcacttctgtttccccggtgattttacataagctgtgcccacggctgaaagtgaatgatccgttacccgctcgagtacttcgaaaagcctagtatcgctttgggatcttcgacgcgttgcgctcagcactctaccccgagtgtagcttaggctgatgagtctgggcattccccatcggcgacgatggcccaggctgcgttggcggcctacccatggctaacgccatgggacgctagttgtgaacaaggtgtgaagagcctattgagctactcgagagtcctccggcccctgaatgcggctaatcccaaccacggatcaggtgcctccaacccaggaggtggcctgtcgtaacgcgcaagtctgtggcggaaccgactactttgggtgtccgtgtttccttttatcttttaaatggctgcttatggtgacaatcatagattgttatcataaagcgaattggattggccatccggtgaaatacaaacacattatttacttgtttgttggatttactccgctcacacagcttactcctaagataatatttattgtattgctggtaaggagacactattata

SEQ ID NO: 3098 - DNA, 675 bp, Porcine enterovirus 9
gaaccttagaagtttacacaaacaaagaccaataggagtccaacacccagttggattgcggtcaagcacttctgtttccccggacctagtagtgataggctgtacccacggccgaagatgaacccgtccgttatccggctacctacttcgggaagcctagtaacattctgaagtctctgaggcgtttcgctcagcacgaccccggtgtagatcgggctgatgggtctccgcataccccacgggcgaccgtggcggaggccgcgttggcggcccgcctatggcgaaagccataggacgcctcttagatgacagggtgtgaagagcctactgagctgggtagtagtcctccggcccctgaatgcggctaatcctaaccacggagcgtccaccagcaatccagctggcagggcgtcgtaacgggcaactctgtggcggaaccgactactttgggtgtccgtgtttccttttgatcctattttggctgcttatggtgacaacgataagttgttatcataaagctcttgggttggccacctggaaaaagttatcagtgtttgatattgttcggctctcacgcctaccaataagacaagccctatatttacttgttgcattttactcgtcagaagaaatcacagagtatcatttggatttgttactcacattaaggacaag

SEQ ID NO: 3099 - DNA, 138 bp, Mouse Mosavirus
gaagttgatcatgaacttggttattggtggaacgcacatgaactcccaacaatgatcttgaagacacagcgtggtaacaattaccatgcccttgtggctgcccaagacattgatggctattgggtgatttatgatgac

SEQ ID NO: 3100 - DNA, 690 bp, Unknown
  Description of Unknown: Kobuvirus SZAL6 5?76 sequence
gaattaaacgggcaccctacccaagggttacatgggaccatattcctcctcccctgtaactttaagttttgtgcccgtattcttgactccaggcggatgttgtgtcgcccgtcctgtgaacaaacagctagacactttcctcccctccctctgggctgctccggcagtccactccctccccccagcgtaacatgccccgctggagtgatgcacctggaagtcgtggacgtgggttagtaacttcggtgaaaacccactataatgacaactggttgacccccacactcaaaggactcgagtctttctcccttaaggctagcccggccacatgaatttgcagctggcaactagtgagtccaccatgtcccgcaacctcggctgcggagtgctgttccccaagcgtatgccttccttctgtaagagtgcgcctggcaagcacatctgagaagtcgttccgctgcgtcgtgccaacctggcgacaggtgacccagtgtgcgtagacttcttccggattcgtccggctcttctctaggaaacatgcgtgtaaggttcatgtgccaaagccctgcgcgcggtgttcttctactgccctaggaatgtgccgcaggtacccctacttcggtagggatctgagcggtagctaattgtctacgggtagtttcatttccatcttctcttcaggtcgacatc

SEQ ID NO: 3101 - DNA, 150 bp, Bat sapelovirus
gacaggtgttttggagggcggatgacgatatctggctggccaccagggaataacggcaaatgtctgatcatacggttcacaagtctaccggcgatagtggttcaacaccatgtgtagcagggattcttgcgtatgtgaaggcgacagtgc

SEQ ID NO: 3102 - DNA, 675 bp, Unknown
  Description of Unknown: Kobuvirus sheep TB3 sequence
gaccttctggtacttcttcgcctgggtcacaaaagcgaagaacctgcctctctaacgccagacgagcggcattaaacttgaacttctggcactctccactctcccttttccctgtccctttccccactgcgctctcaaggtcgcgcaatcctgggactagcccagttttaaaagttcctggcaccctttgcccctctaggcccttaaggtaggaactgaccttgtgctgtgatctcggtgcgggagtgctaccacgtagtcatcgtaagcctcgtttctggttctgccctggcaaggctacagagtaccgtgttccgctgtggatgccatccgggtaaccggacccccagtgtgtgtagcggtatgttcacggtccgccgtgttcaccagattcctgacctggctttgctagaaatggtgtgtgcccaatccctgtgaccagtatcaattacatcacctaggaatgctaggaaggtaccccagtcctgagctgggatctgatcctaggctaattgtctacggtgatgctccttttattttcttacaactgctattgactgtctgattgctgattctgctcttgtgctcttctgctctggctcattctcaagggttctctttgtccaagatcctttggttctctccttgttccacttgccactgccaacgcttgtc

SEQ ID NO: 3103 - DNA, 459 bp, GB virus C
  K1737
gacgtgggggggttgatcccccccctttggcactgggtgcaagccccagaaaccgacgcctatttaaacagacgttaagaaccggcgccgacccggcgaccggccaaaaggtggtggatgggtgatgccagggttggtaggtcgtaaatcccggtcatcttggtagccactataggtgggtcttaagggttggttaaggtccctctggcgcttgtggcgagaaagcgcacggtccacaggtgttggccctaccggtgtgaataagggcccgacgtcaggctcgtcgttaaaccgagcccactacccacctgggcaaacaacgcccacgtacggtccacgtcgcccttcaatgtctctcttgaccaataggcttagccggcgagttgacaaggaccagtgggggctgggcggtaggggaaggacccctgccgctgcccttcccggtggagtgggaaatgc

SEQ ID NO: 3104 - DNA, 341 bp, Hubei sobemo-like virus 3
gagatgtttgcgtgggccgttgcgctgcgggcggcccacctccctacggggaccgtgagacaccgctggggaaggcccccacccccggccaaggggatcctgccgagaggcaggagaaagaggcccagccctctggggcgcctttaggggtgcctgggagggaagtacccgagccgggcggccggtcgggtgcggctgtgcagttcgaggctaaccgtaaggaaggcctgagctgcctcggcttgtcggaaaggaagacgaaggcacttatcaaggctttcaggaagcaggagcgcaattacagcgcgcgccgtgcggcctggattaaccgcatttggccg

SEQ ID NO: 3105 - DNA, 579 bp, Unknown
  Description of Unknown: RhPV sequence
gataaaagaacctataatcccttcgcacaccgcgtcacaccgcgctatatgctgctcattaggaattacggctccttttttgtggatacaatctcttgtatacgatatacttattgttaatttcattgacctttacgcaatcctgcgtaaatgctggtatagggtgtacttcggatttccgagcctatattggttttgaaaggacctttaagtccctactatactacattgtactagcgtaggccacgtaggcccgtaagatattataactattttattatattttattcaccccccacattaatcccagttaaagctttataactataagtaagccgtgccgaaacgttaatcggtcgctagttgcgtaacaactgttagtttaattttccaaaatttatttttcacaatttttagttaagattttagcttgccttaagcagtctttatatcttctgtatattattttaaagtttataggagcaaagttcgctttactcgcaatagctattttatttattttaggaatattatcacctcgtaattatttaattataacattagctttatctatttata

SEQ ID NO: 3106 - DNA, 212 bp, Betacoronavirus HKU24
gataaagtgtgaatcgcttccgtagcatcgcaccctcgatctcttgttagatctaatctaatctaaactttataaaaacactaggtccctgctagcctatgcctgagggtttaggcgttgcatactagtgtcttaggaatttgactgataacacttccctgctaacggcgtgttgcactctcagtctaagcctcccacccataggaggtatc

SEQ ID NO: 3107 - DNA, 675 bp, Unknown
  Description of Unknown: Parabovirus C sequence
gatgtatccccatcccccagtgtgtatgccatactgcatagctcgcctatgccctatggattcacaaccctttcatataccctccctacccaaccccgtaaccacatgctttactccgcttggggttttgcggccccatgttgtgacgaaatggctacgcaatcaatgcggctaatggggcctgccgcttttaagtggccccagttagaagtttatgcacacccgcccattaggaggccaccagccaggtggtcagagggcaagcacttctgtttccccggtgaagtttgataagctgtgcccacggctgaagcagacagatccgttacccgcctcactactacgagacggctagtagtgtgtaatatccgaatttcattgatccgggtgttccccccacccagaaacgtgtgatgaggagcggcacccctcctatggcaacatagggcctctcctgcgctggcacacgggctctatgagcatgaaatcaggagaaagtcacacgaagaccttattgtgctagtgttgattcctccgcccccctgaatgcggctaatcccaactccggagcgcccgctggcaaacccgccagaagagcgtcgtaatgcgtaagtctggagcggaaccgactactttgggtgtggcgtgtttcctttatttcctttgtatttgtat

SEQ ID NO: 3108 - DNA, 675 bp, Harrier picornavirus 1
gatgtgtgacggtgtaattactttccggatcccactttcctattataactctttcatcccaaggttagggaaagaacctggctcggtaccaccagaccctccgccacgctagtggactctccggagataacggtaccccctttgtagtcacctgtgctggtgaagaaccacctagtattgcttgggtgcgtgccgcctagcttccatttcttctggagcactgtgcaatgaggtttccccacttggtaacaagtgcctcaggtcccgcaaggatactgtggggtggtgtgaccgcagggagctgtctccacggctcctctaatgttacgccgctatccacaggccagtgcgtgtcatcgatcccggatgacagagctagtattgcgaacccccaagtaagaaaagtggctagtaacctgatagctggtgaagagggtgggtcagttgagtagatgccctagaggtacccgaaaggatctgactagggacccgtgactatacattaggtaaaccgggtataaaaaccatgaaaaactgaccacttttcttttaacctcttctttctttttatgtgtgttaagtgttttgagtttggactgtaccttgcccgcctttcttggattttctctatcgctcttcttacacctactgttatcaaggcactctttagagata

SEQ ID NO: 3109 - DNA, 623 bp, Cripavirus sp.
gcaaaatcggtagtacgttaaacgtacgaccaccgatgagactgaaatgacactagttgagattatttcaatatcctagtgttataaagtcaatatttgttggttgatcgtttcgtcaatcgatggcgctgacagccggaaagacggcaataataaaaaccaagatttagtttttaagttttgattgaattgcaaaagctatcttgaatagacaatcaaaatattaagtaaagcaaaagcttcttaaagaagacaatatttaattagttagtaaccaaacctcatcgtgcccctaagggttaaccggttacgtaaaagcgtagaggtattaaggtcactgcggagacctaaaatccgcaattttatgttttgtaatgttttagttatagacttagatgtaactataagagtttataaatacttgtttcaagatttatagacaagatctgatcctatggattttagataaccttcatgttagtggatagtgtgtgtacctatctaaacgcataaggctcttatttcatatttaaagtaggactatgtattacggcgcatctaacggtaacgttagtcaagaccggagaatctcggaatgaattttagtaattcccaaatttata

SEQ ID NO: 3110 - DNA, 570 bp, Plautia stali intestine virus
  (2x mut for Xba1)
gcaaaatgggtacgtagttaaccactgcgtatcaggattgcaggccacgaagggtatttgcatatctttctatgcggtattacggcttaaaacccgttgtatcttgttgtttgactgcctgtatcactagtggccattttatttaggttagagacccctgatagtaggagagttacaaactctttaaaaattgttgaccccggaaaagatggtgacccctgtaagtagttgatcaagaagatctatgcgctggcatagtaatccagtgtttcctgttttaggatgacctctgaaagtagatgaccgtggaaagtcacgtagtgccccaataagcacgtttgggcagcgtgcgctatcacaaggcttgatctccgaggagccccttgttttagctggctggaagccaatgatcttaagtagataagtgctgttgcttgtagttcaacagaaagctttgagtacgtctttcttgcgagaaagaacacatgcattcttatgctctcaattctattatttttattttgggcgaaaggaaagctctcacgcgagtacgaatagccaaccctttat

SEQ ID NO: 3111 - DNA, 675 bp, Hepatovirus G
gcaaggggtggttttaaccttgcacgcgtttaccgtgcgttaacggttttccatgtttgtatgtcttgtttgtattatgtgttttgtaaatattaattcctgcaggttcagggttctttaatcatgttgggctgtacccacactcaacttttggccataagtgagtttcttaacgaaccttttaacacaggatgttattagggcccaatattttccctgaggccttctttggcctctattttttccccttttctatctccttgtattccgggctcacgtgatgccaatggactgacccatgcgcccgtgggggttaactactggagtagccagtagctgtaggtgctaaaagtcacgtacgtgtaagactggacgagacctctcagctataactgaaagtagtaagtatgtctgaacttcttgaaggggtaggctacgggtgaaaccccttaggttaatactcatattgagagatacctctgataggtgaaggtttccggtagaggtgagtttaacgacaaagcctctcaacggatgtgggcccacctcatcagcaagatgctttcatacccaataccgtaggggctgggttgttgagttcagtcccaagcgtccctcccgcaaggttgtaggggtactcaggggcatttaggtttccacaattaaacaaataca

SEQ ID NO: 3112 - DNA, 675 bp, Unknown
  Description of Unknown: EV F1 BEV 261 sequence
gcaatgctgcaccagtgcactggtacgctagtaccttttcacggagtagatggtatcccttaccccggaacctagaagattgcacacaaaccgaccaataggcgcaccgcatccagccgtgcagcggtcaagcacttctgtctccccggtctgtaaagatcgttatccgcccgacccactacgaaaagcctagtaactggccaagtgaacgcgaagttgcgctccgccacaaccccagtggtagctctggaagatggggctcgcaccacccccgtggtaacacggttgcctgcccgcgtgtgcttccgggttcggtctcgtgccgttcacttcaacttcacgcaaccagccaagagcctattgtgctgggacggttttcctccggggccgtgaatgctgctaatcccaacctccgagcgtgtgcgcacaatccagtgttgctacgtcgtaacgcgtaagttggaggcggaacagactactttcggtaccccgtgtttcctctcattttatttaatattttatggtgacaattgttgagatttgcgctcttgcaacgttgccattgaatattggcttatactatttggttgccttttacaaaacctctgatatacccagttcttacattgatctgcttgtttttctcaatttgaagtatagactacaaatagcaaa

SEQ ID NO: 3113 - DNA, 123 bp, Porcine pestivirus 1
gcagatatcggtggtggacctgggggttgggctcaccgtgccccttcatggggtagacctcactgcttgatagagtgccggcggatgcctcaggtaagagtataaaatccgttgttcactaac

SEQ ID NO: 3114 - DNA, 472 bp, Botrytis cinerea mitovirus 4
  RdRp
gccccgccgaccttcctatttatttctaaataggaaggtcccgactagtcggataattcggtttaacgaattatggttagatctattaaagttaaaatagattgaatttctttctcatcctccttattcctatactttgggagtaaatgacaaatgtctatcctcaaaccgaaatggcttaagtgatgaatttgaaagaaaggtaggttttaagaatataaggcatcaatatattatacccttgaatgttaagtgaccacggcgtgacgattagggctatcttaggatagacagccatctaacgcgacagcagtggaaatcagcttagcatctcaagatcatgtataatatatacataaccttacaattataaaaccaaaccaaaacacactataattttatataaattatagaagtatcggacctggacggtacctactattaactgatagtagccaaatgcaggaagctc

SEQ ID NO: 3115 - DNA, 415 bp, Grapevine associated narnavirus-1
gcccggggggtgcagtcctgtgaaagggtctgcaccatactatatatgtatatgattacatcccaaaaggcgacttcgttcaggttttaaatctgacgtaggtccagtaaataagcatgtcaaaacatgtaagtttatcctgtaatctactctcataagatgagataagatgatattgcagttcccatgtaaataaatccattatgaattcattcatataaggtagaagtggtaactatggttgaaacattaatataaaacggtcattttgcatgaacgtcattaaggaactggcataccaatgtctatttagtgactatgatatttagagtatcccttatattaattaacaattattccttttagcatatcatccgacaacaaattttaaaagaagaaatattactcattaaaa

SEQ ID NO: 3116 - DNA, 675 bp, Parechovirus A
gccgtcgggccttacaccccgacttgctgagtttctctaggagagtccctttcccagccagaggtggctggtcaaacaataccaaacgtaactaaacatctaagataacatagccctatgcctggtctccaccagttgaaggcatcttgcaataaaatgggtggattaagacgcttaaagcatggagtcaattatcttttctaactagtgatcttcactgggtggcagatggcgtgccataactctattagtgggataccacgctcgtggatcttatgcccacacagccatcctctagtaagtttgcaaggtgtctgatgaggcgtgggaacttattggaaataattacttgctgcgaagcatcctactgccagcggatcaacacctggtaacaggtgcccctggggccaaaagccacggtttaacagaccctttaggattggttaaaacctgagtaattatggaagatacttagtacctaccaacttggtaacagtgcaaacactagttgtaaggcccacgaaggatgcccagaaggtacccgcaggtaacaagagacactgtggatctgatctggggccacctacctctatcctggtgaggtggttaaaaaacgtctagtgggccaaacccaggggggatccctggtttccttattttagtgtaaatgtcatt

SEQ ID NO: 3117 - DNA, 224 bp, Equine arteritis virus
gctcgaagtgtgtatggtgccatatacggctcaccaccatatacactgcaagaattactattcttgtgggcccctctcggtaaatcctagagggctttcctctcgttattgcgagattcgtcgttagataacggcaagttccctttcttactatcctattttcatcttgtggcttgacgggtcactgccatcgtcgtcgatctctatcaactacccttgcgact

SEQ ID NO: 3118 - DNA, 743 bp, Unknown
  Description of Unknown: CVA10 sequence
gctcttccgatctgggttgttcccacccacagggcccactgggcgccagcactctgattccacggaatctttgtgcgcctgttttacaacccttcccaatttgtaacgtagaagcaatacacactactgatcaatagtaggcatggcgcgccagtcatgtcatgatcaagcacttctgttcccccggactgagtatcaatagactgctcacgcggttgaaggagaaaacgttcgttacccggctaactacttcgagaaacctagtagcaccatggaagctgcggagtgtttcgctcagcactttccccgtgtagatcaggtcgatgagtcactgcaatccccacgggcgaccgtggcagtggctgcgttggcggcctgcctatggggcaacccataggacgctctaatgtggacatggtgcgaagagtctattgagctagttagtagtcctccggcccctgaatgcggctaatcctaactgcggagcacatgccttcaacccaggaggtggtgtgtcgtaacgggtaactctgcagcggaaccgactactttgggtgtccgtgtttccttttatccttatattggctgcttatggtgacaatcacggaattgttgccatatagctattggattggccatccggtgtctaacagagctattgtatacctatttgttggatttactcccctatcatacaaatctctgaacactttgtgctttatactgaacttaaacacacgaaa

SEQ ID NO: 3119 - DNA, 145 bp, Unknown
  Description of Unknown: PSIV IGR sequence
gctgactatgtgatcttattaaaattaggttaaatttcgaggttaaaaatagttttaatattgctatagtcttagaggtcttgtatatttatacttaccacacaagatggaccggagcagccctccaatatctagtgtaccctcg

SEQ ID NO: 3120 - DNA, 664 bp, Unknown; identical to SEQ ID NO: 1316
  Description of Unknown: Aichivirus DVI2321 sequence

SEQ ID NO: 3121 - DNA, 675 bp, Megrivirus E
gcttggcaacctcatatcgttactctgccgaccagtctgggtcgtgtggccacacaatgggattcgttctgttgtgtagagtcacatggcattactgggctgatcggtggggatccgttgccacccctaaacccttacatttactggactgcttttcttggccccggaatgattcgctcacccgcgatgaggactgttgttcttattatggcaggattacgcgtctggtccgcgtaaggactaattcctatgtttatacgttactaccttgttctgaacggtgggcgccaccccgcctagtaggatcctggcttatcgtgtagacctctagggaccacattagctagagtgtaggctgctatggatggagtagtgacccctttttgggtatcactctctaagactccggaatgtgtcatagtacgctggaaatccttacttgtttttccatgagggggaggtggtgctgaaatattgcaagccacccctcggttaaaacagtttggtgccgcttatgccatattaccgccccttgtagttgggctgtttttgcagctccgggttagtagagtaccatagtggacgcggtgttgggaatcaccgccttggctgcacactgcttgatagagctgcggctggtcaagctaattgtggtataaccagttgatttggcat

SEQ ID NO: 3122 - DNA, 631 bp, Avian orthoreovirus
  segment S1
gctttttcaatcccttgtgtcgatgttcccgtatgtcatctggttcatgtaacggtgcaacttctatttttggtaacgttcactgtcaggcagcgcaaaactcggcgggtggtgatcttcaagcgacttcctctcttgttgcttattggccctacttggctgcgggcggtggtctgctcgttgttattattataattgttggcgctgtttgttgttgcaaggctaaggttaaagcggacgcagcccgaaacgttttctaccgagagctgttcgcacttaattcgggtaaaagtgatgcaggacctccgatttaccaggtttagtgtacgacgatttgagttttcacctttcgtcttagaggagtgcactactccatctttcacgactataactaataccgatccggctctctactttaacattgagtttccgtcaagtcatcgtctctcccccttcattccagaactgttgtctcagccttgtaccgttcacgtttcattgattcggagattcgctctctgtgcaaccttatctagtatttgtgaatacgactgtgcgctactgccatccatcaacgctattacgacgatccctacaccaggtgcgtcatcatctctgattgttcattggg

SEQ ID NO: 3123 - DNA, 315 bp, Botrytis cinerea mitovirus 2
  RdRp
ggaacttttcagttccagaagtggctttattaagccttcaaagtttacactttgaacctgcgattaattccccatagtgactcttgttactgtgaattaggaatagttgtagttcaacttctaatgaggtgaacaatataataactcatcttattaaccctatacgtagacaattgtccaaagagacagttggaattctgccaatctggaatgtttggtacgcgtagaagataataagagaccctctattcccctgcctcatgactaagtcatggcccggggtgtaatagagatacttttatatattatacaatc

SEQ ID NO: 3124 - DNA, 458 bp, Basella alba endornavirus
ggaatatggctaatcggcttattctaatcaaacgcaaaagacttatgacacagaccggacctgaacgaggtgataaaacacctcgttcaggttcaaaacgtagaagattcattcctccgattagaaatacaactacgtctaagcacgatagagatggtatcaagatcggttttagaccacgagaaaatcggcaaatgaaagtacaagttgggtggtttaaattaccaagaacagtaacattcaagaacaacggcaacccgtttgttacctcatttcgtaaattgtttagaagtaacaaagataaattatttaatggtgggaagaacctaagtacagtaccagccagaagtagtgaaatgacagaaatgtttatgttcatgtccacgctagagggccaattgtcaatccaagatcgagatccaaaaataatcaataagtctatatacatgatagaggta

SEQ ID NO: 3125 - DNA, 600 bp, Hubei tombus-like virus 9; identical to SEQ ID NO: 196

SEQ ID NO: 3126 - DNA, 675 bp, San Angelo virus
  P-113
ggagatctaagtcaaccgactccgacgaaactaccatcatgcctccccgattatgtgatgctttctgccctgctgggtggagcatcctcgggttgagaaaaccttcttcctttttccttggaccccggtcccccggtctaagccgcttggaataagacagggttatcttcacctcttccttcttctacttcatagtgttctatactatgaaagggtatgtgtcgccccttccttctttggagaacacgcgcggcggtctttccgtctctcgaaaagcgcgtgtgcgacatgcagagaaccgtgaagaaagcagtttgcggactagctttagtgcccacaagaaaacagctgtagcgaccacacaaaggcagcggaccccccctcctggcaacaggagcctctgcggccaaaagccacgtggataagatccacctttgtgtgcggcacaaccccagtgccctggtttcttggtgacacttcagtgaaaacgcaaatggcgatctgaagcgcctctgtaggaaagccaagaatgtccaggaggtaccccttccctcgggaagggatctgacctggagacacatcacatgtgctttacacctgtgcttgtgtttaaaaattgtcacagctttcccaaaccaagtggtcttggttttcactctttaaactgatttcact

SEQ ID NO: 3127 - DNA, 675 bp, Cosavirus B1; identical to SEQ ID NO: 3081

SEQ ID NO: 3128 - DNA, 675 bp, Cosavirus D1; identical to SEQ ID NO: 3082

SEQ ID NO: 3129 - DNA, 675 bp, Unknown; identical to SEQ ID NO: 3083
  Description of Unknown: EV D94 sequence

SEQ ID NO: 3130 - DNA, 675 bp, Rabovirus A; identical to SEQ ID NO: 3084

SEQ ID NO: 3131 - DNA, 113 bp, Antarctic penguin virus A; identical to SEQ ID NO: 3085

SEQ ID NO: 3132 - DNA, 675 bp, Ljungan Virus 87-012; identical to SEQ ID NO: 3086

SEQ ID NO: 3133 - DNA, 568 bp, Encephalomyocarditis virus; identical to SEQ ID NO: 3087
  B

SEQ ID NO: 3134 - DNA, 675 bp, Yak enterovirus; identical to SEQ ID NO: 3088

SEQ ID NO: 3135 - DNA, 645 bp, Caprine kobuvirus; identical to SEQ ID NO: 3089
  d30

SEQ ID NO: 3136 - DNA, 654 bp, Seneca valley virus; identical to SEQ ID NO: 3090

SEQ ID NO: 3137 - DNA, 410 bp, Shingleback nidovirus 1; identical to SEQ ID NO: 3091

SEQ ID NO: 3138 - DNA, 291 bp, Camel alphacoronavirus; identical to SEQ ID NO: 3092

SEQ ID NO: 3139 - DNA, 675 bp, Unknown; identical to SEQ ID NO: 3093
  Description of Unknown: HAV FH1 sequence

SEQ ID NO: 3140 - DNA, 675 bp, Halastavi arva; identical to SEQ ID NO: 3094
  (1x mut)

SEQ ID NO: 3141 - DNA, 660 bp, Malagasivirus B; identical to SEQ ID NO: 3095

SEQ ID NO: 3142 - DNA, 675 bp, Hepatovirus D; identical to SEQ ID NO: 3096

SEQ ID NO: 3143 - DNA, 675 bp, Unknown; identical to SEQ ID NO: 3097
  Description of Unknown: EV C102 sequence

SEQ ID NO: 3144 - DNA, 675 bp, Porcine enterovirus 9; identical to SEQ ID NO: 3098

SEQ ID NO: 3145 - DNA, 138 bp, Mouse Mosavirus; identical to SEQ ID NO: 3099

SEQ ID NO: 3146 - DNA, 690 bp, Kobuvirus sp.; identical to SEQ ID NO: 3100
  SZAL6 5?76

SEQ ID NO: 3147 - DNA, 150 bp, Bat sapelovirus; identical to SEQ ID NO: 3101

SEQ ID NO: 3148 - DNA, 675 bp, Kobuvirus sp.; identical to SEQ ID NO: 3102
  sheep TB3

SEQ ID NO: 3149 - DNA, 459 bp, GB virus C; identical to SEQ ID NO: 3103
  K1737

SEQ ID NO: 3150 - DNA, 341 bp, Hubei sobemo-like virus 3; identical to SEQ ID NO: 3104

SEQ ID NO: 3151 - DNA, 579 bp, Unknown; identical to SEQ ID NO: 3105
  Description of Unknown: RhPV sequence

SEQ ID NO: 3152 - DNA, 212 bp, Betacoronavirus HKU24; identical to SEQ ID NO: 3106

SEQ ID NO: 3153 - DNA, 675 bp, Parabovirus C; identical to SEQ ID NO: 3107

SEQ ID NO: 3154 - DNA, 675 bp, Harrier picornavirus 1; identical to SEQ ID NO: 3108

SEQ ID NO: 3155 - DNA, 623 bp, Cripavirus sp.; identical to SEQ ID NO: 3109

SEQ ID NO: 3156 - DNA, 570 bp, Plautia stali intestine virus; identical to SEQ ID NO: 3110
  (2x mut for Xba1)

SEQ ID NO: 3157 - DNA, 675 bp, Hepatovirus G; identical to SEQ ID NO: 3111

SEQ ID NO: 3158 - DNA, 675 bp, Unknown; identical to SEQ ID NO: 3112
  Description of Unknown: EV F1 BEV 261 sequence

SEQ ID NO: 3159 - DNA, 123 bp, Porcine pestivirus 1; identical to SEQ ID NO: 3113

SEQ ID NO: 3160 - DNA, 472 bp, Botrytis cinerea mitovirus 4; identical to SEQ ID NO: 3114
  RdRp

SEQ ID NO: 3161 - DNA, 415 bp, Grapevine associated narnavirus-1; identical to SEQ ID NO: 3115

SEQ ID NO: 3162 - DNA, 675 bp, Parechovirus A2; identical to SEQ ID NO: 3116

SEQ ID NO: 3163 - DNA, 224 bp, Equine arteritis virus; identical to SEQ ID NO: 3117

SEQ ID NO: 3164 - DNA, 743 bp, Unknown; identical to SEQ ID NO: 3118
  Description of Unknown: CVA10 sequence

SEQ ID NO: 3165 - DNA, 145 bp, Plautia stali intestine virus; identical to SEQ ID NO: 3119
  IGR

SEQ ID NO: 3166 - DNA, 664 bp, Unknown; identical to SEQ ID NO: 1316
  Description of Unknown: Aichivirus DVI2321 sequence

SEQ ID NO: 3167 - DNA, 675 bp, Megrivirus E; identical to SEQ ID NO: 3121

SEQ ID NO: 3168 - DNA, 631 bp, Avian orthoreovirus; identical to SEQ ID NO: 3122
  segment S1

SEQ ID NO: 3169 - DNA, 315 bp, Botrytis cinerea mitovirus 2; identical to SEQ ID NO: 3123
  RdRp

SEQ ID NO: 3170 - DNA, 458 bp, Basella alba endornavirus; identical to SEQ ID NO: 3124

SEQ ID NO: 3171 - DNA, 600 bp, Hubei tombus-like virus 9; identical to SEQ ID NO: 196

SEQ ID NO: 3172 - DNA, 675 bp, San Angelo virus; identical to SEQ ID NO: 3126
  P-113

SEQ ID NO: 3173 - DNA, 675 bp, Hepatovirus I
ggctgcctgtgtctcaggggtaagtactggggccgcgttgaccgtgcggtacggttatgcttttagattaggatgtccgtctgtccggcactctcttttgcttaaaatggccttaaatccatgggaggcgtaaccatgggccctttgttacctagacatgattgcattgggggccgtccttggggcttaggccccagccatttctcttgactcgtctaagagtttacttcatccttttctttactttattttccaggctctcagcatgccgacggctctgaccactgcgcccggtggggttaactgcatgattagcatgcagctgtaggagttaaaagtgctgacaggccaattctgacgtaagtccactctatattaacttgatcaagtaaggttgattgatctttgtgagagggtaggctacgggtgaaaccctctaggttaatactcatattgagagatacctccagaaggtgaaggttggcggatattggtgagttcttttaggacaaaaacctttcaacgcctgtgggcccacctcactggcacaatgctttcatccccaattgtgatgggtagtttggactgaaatcaggagtaacctgccctacgagtttaggggtagttcaggggtatttaggcttccacatttgatagagtttatgagagtgagcc

SEQ ID NO: 3174 - DNA, 280 bp, Hepacivirus K
gggaacaatggtccgtccgcggaacgactctagccatgagtctagtacgagtgcgtgccacccattagcacaaaaaccactgactgagccacacccctcccggaatcctgagtacaggacattcgctcggacgacgcatgagcctccatgccgagaaaattgggtatacccacgggtaaggggtggccacccagcgggaatctgggggctggtcactgactatggtacagcctgatagggtgctgccgcagcgtcagtggtatgcggctgttcatggaac

SEQ ID NO: 3175 - DNA, 280 bp, Hepacivirus K; identical to SEQ ID NO: 3174

SEQ ID NO: 3176 - DNA, 638 bp, Phopivirus; identical to SEQ ID NO: 764
  strain NewEngland

SEQ ID NO: 3177 - DNA, 675 bp, Parechovirus A8
gggccttataccccgacttgctgagtttctctaggagagtccctttcccagccctgaggcggctggataataaaggcctcacatgtaacaaacatctaagacaaaataatttgccttgcacctggtccccactagttgaaggcatctagcaataagatgagtggaacaaggacgcttaaagtgcaatgatagttatcttttctaacccactatttatagtggggtggtggatggcgcaccataattctaatagtgagataccacgcttgtggaccttatgctcacacagccatcctctagtaagtttgtgagacgtctggtgacgtgtgggaacttactggaaacaatgctttgccgtaaggctttcattagccagcggaccaccacctggtaacaggtgcctctggggccaaaagccaaggtttaatagaccctaatggaatggttcaaacctggagcattgtggaaagtacttagtacctgctgatctggtagtaatgcaaacactagttgtacggcccacgaaggatgcccagaaggtacccgtaggtaacaagtgacactatggatctgatctggggccaactacctctatcttggtgagttggttaaaaaacgtctagtgggccaaacccaggggggatccctggtttccttttattttactttgtcaat

SEQ ID NO: 3178 - DNA, 675 bp, Rabbit Kobuvirus
gggctataaatatgggcattcctcttcccccttccccttttgaagatgagtgcgcatattcttgactccgcctggattggccgcccaaggcgtgaacaagcagctaggccaccatgacactgcggtggtgtccgaacccgcgggtgccttcacgggcacctgtggtatgtaggactcccaccgtggtcttccctttccccctcaatctttccccctggttcgactaacgggaccagtgctggaacctgtccggtgaacggtatagcaggcccccccggcagaaacacccggtgcttaccccttaaggctagcccccttccatgaatttggttggggcaactagtgggtgtacagttggcgtgaaccctccggtctaggagtgctcttgcccaatcctctgtgtgtgccttgcagtagggactggcaatccttcgcgtaggtgatccgctgtgccatgccatcctggcgacaggaggcccagtgtgcgcaacctacgtcccttctgggtgctgcattgcattacctttggagtaagcttggtgtgccgaaaccccagggtttacgtaccactcgtggtgtgaggaatgtgccgcaggtaccccatccttgaggtgggatctgagcggtagctaattgtctagcaccactttcttccttttttctttgctggtcacg

SEQ ID NO: 3179 - DNA, 520 bp, Simian pegivirus
ggggaatctcaccccccgtccggttccggaagaatcggaaaccgacaccctgaccaatcattcttgatcatagagtggatgttagtgaaagccagacgaaagccggcggatgggtggtgacagggttggtaggtcgtaaatcccggccaccctggtacccggtataagttgggcggaagctgactgaagctccgtgctcttttctgtgcgttcttggtgcacggtccacaggtgacgcctataccggtgtgaataataggccgactcgagcggagtcgttaaactgagaacctccatacggatggcaacttggcttgcgtacggggacgccgctaaagtcacagtgggttaagtccggcgggttgacaaccccagcaaggcgagggggtcctattgttggactctgccagttcccggtggaggtaggcatggggtggcccagctccgcggcgcgctacagccggggtagcccaaaatccgaaaggtgagggcgggccacatgtccgaaatttagtcaagc

SEQ ID NO: 3180 - DNA, 665 bp, Caprine kobuvirus
  d10
ggggcctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 3181 - DNA, 549 bp, Unknown
  Description of Unknown: CK SZ1-L1S sequence
gggggtggggggggcctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgaaccacccaggaatgccagggaggtaccccgcttcacagcgggatctgaccctgggctaattgtctacggtggttcttcttgcttccacttctttctactgttcgccacc

SEQ ID NO: 3182 - DNA, 553 bp, Unknown
  Description of Unknown: CK Aichi Scan (AV-S) sequence
gggggtggggggggcctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcatttccaatccttttatgtcggagtc

SEQ ID NO: 3183 - DNA, 667 bp, Unknown
  Description of Unknown: CK Aichi Loop (AV-L1) sequence
gggggtggggggggcctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgaactgccctaggaatgccaggcaggtaccccacctccgggtgggatctgagcctgggctaattgtctacgggtagttttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 3184 - DNA, 693 bp, Unknown
  Description of Unknown: CK SZ1-L2 sequence
gggggtggggggggcctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcctgatcccccgcggaagctgctcacgtggcaactgtggggacccagacaggttatcaaaggcacccggtctttccgccttcaggagtatccctgctagtgaattctagtagggctctgcttgcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 3185 - DNA, 671 bp, Unknown
  Description of Unknown: CK Aichi TriLoop (AV-L2) sequence
gggggtggggggggcctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcatgtgcctggcaagcatatctgagaaggtgttccgctgtggctgccaacctggtgacaggtgccccagtgtgcgtaaccttcttccgtctccggacggtgcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 3186 - DNA, 523 bp, Unknown
  Description of Unknown: CK Scan Deletion (?S) sequence
gggggtggggggggcctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtg

SEQ ID NO: 3187 - DNA, 592 bp, Unknown
  Description of Unknown: CK Loop Deletion (?L1) sequence
gggggtggggggggcctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgatttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 3188 - DNA, 572 bp, Unknown
  Description of Unknown: CK Triloop Deletion (?L2) sequence
gggggtggggggggcctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 3189 - DNA, 675 bp, Caprine kobuvirus
  12Q108
gggggtggggggggcctcggccccctcaccctcttttccggtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 3190 - DNA, 577 bp, Unknown
  Description of Unknown: REV A sequence
ggggtcgccgtcctacacattgttgtgacgtgcggcccagattcgaatctgtaataaaagctttttcttctatatcctcagattggcagtgagaggagattttgttcgtggtgttggctggcctactgggtggggtagggatccggactgaatccgtagtatttcggtacaacatttgggggctcgtccgggattcctccccatcggcagaggtgcctactgtttcttcgaactccggcgccggtaagtaagtacttgattttggtacctcgcgagggtttgggaggatcggagtggcgggacgctgccgggaagctccacctccgctcagcaggggacgccctggtctgagctctgtggtatctgattgttgttgaaccgtctctaagacggtgatactataagtcgtggtttgtgtgtttgtttgttaccttgtgtttgttcgtcacttgtcgacagcgccctgcgaattggtgtacccacaccgcgcggcttgcgaataatactttggagagtcttttgcctccagtgtcttccgtttgtactcgtcctcctctccctctccggccgggatggg

SEQ ID NO: 3191 - DNA, 675 bp, Orivirus sp.
ggtcccaggccaatattcttcgtaaggcttggttccaattttccaccactcgtgtttgggttctggcctatggtacccagaggggcggtttgggggaattaactccccctcccctgtggtcctataccaccccacacctctgtgggctttctttactatcttcttgttttccgacttttaaacactaggcaggcgcgcctagtcatacaccgcccggctggtctttccagctcttgtgggcggtgcgcgctggtccatcgtgcccagcgacatagcaccttgtggacacctccgaacgccctcccctgtatggggtggtgcccaggggtttcagtgtggtgacacactccctggggcccgaaaggctagtgtgcaacaggtgaggtacagccagctgcccccgtggctggagggaccaagcttgtgaagcacacctcaccttcttgggggtgggctagtaagtggtgaaagcatagtgtccgtgtcgctggccaacactttgggtcaagtccagccactcagtgagtagatgcccaggaggtacccctagtggatctgacttggggcctgttacttaatgcaggttaaaaactatgaaagctgagtagtgtagcccggctggtggcttctcttccttattcattctattttatggtgacaaacgcaactgaagcc

SEQ ID NO: 3192 - DNA, 303 bp, Chicken calicivirus
ggtgcatcatcactgaacaccctcgggcagagatgcaagggtggaagtcactcctgccccctggcaacatgcaggtgcccgatcccaagcttagttctgacttcctctcctgggtggtgcaacactccaaggttgatgaacaaacctggagggacctctgggcaacctggtctctcgaggatctccggcgcatctccacagactacctcatgctcccggaacctgagaagaacactgatgcctatgatggctggctgatggtcggcgagatgttgacctttgccggtctcattggctgggagg

SEQ ID NO: 3193 - DNA, 240 bp, Unknown
  Description of Unknown: Ia Io sequence
ggtgtccgggtgtgtgggatagacccagatgtgcagtggatgcgagcatttgagtcagagtaggagcaagcccaggggcaaagggaccacattgtgtatcccgaatgaaggatcgagatttctctcctcattacccggtgtcttgtcactgttgggggggcccaacagtcttagtcctatactgcctgatagggtcgcggctggccggactcaagtgctatagtcagttgattttcactc

SEQ ID NO: 3194 - DNA, 156 bp, Picobirnavirus sp.
gtaaattaaatgctatttacaaaatttaaacagaaaggagagatgttatgaaccggttttacaaggtttcatacatcgaaaatagcactacctggggcagccgacacactaacatcgtctgtttaaccagaagtgttactgaaaggaggttattta

SEQ ID NO: 3195 - DNA, 675 bp, Lesavirus 1
gtaactaataagcaagttttactgcctgcaaactgcttcaatgggaccaccgcttcggcgacccctttgttgagtttgtatgtttttaagtaatctttgcaaccatacgattattttagccgcctctctataatgatcttgttatagtgggacgtgaaacattggtttttctcacacacgtccggtcacccgggcgtgtgttcttccgtaagtcctatccacataccatcgtgggtaggccagcatgtttgcacaggctgtgacagtgtgggtgggctttccacctctcaacaacacactgaattgcaatgcactcacggaggaaatgacaatttggttatagttttgaactgtgctagtaatttctttcacattaagccatgttgcctgcggaatcacatgtggtaacacatgcctcagggcccaaaaggcacgggttagcagccccttcatggtgtgttagaagtgaaaacacatagtatgagctataatatctttgttgtcttctctgtagtgtaccccgccaaatgtaaggatgcccagcaggtacccattttatggatctgagctggggattgatagtgtatctataaatgcactgatcaatttaaaaagcgtctaagtttggcacaaacactggggacagtgtttttcctttattcttttatttgatta

SEQ ID NO: 3196 - DNA, 675 bp, Goat torovirus
gtacttacaagcgggttaaaccgccctccggaacggttacaaccccctcccgaacgtgcgcttgacgtgactggttctcagtctggctttctgagaaatactccagggttgtatcccaccatcttgacctctggtcattttggtaacaccataaccaaacaaactctacacacctaacccacctccagcttgctgcaggccttttggactaaacgggtttaggtgttttgtgaccaactcgtctacccacctccagttttactgcaggcctttttggactaaacggctttagacttttgtggttagtttttaactacccactgtttagccgccaacctgattttcattgttgtaaaattttgtgtttatacactattttcatacggttggcagtttgtttggttgtttgcacagtttttgttgataccaatttttactgtgcttttagtgtattctgctaaggctgtattttacatacttagtttggttgaagcaatttttacaacatttatattgtttttgatttctaaggtaaagagtcttaggaaacaccatagacgccattcttgtggtgtctagttccaactaatctggcaaacaagtaccaagtcattgactcactttggagtgagacttacgagtaccaatttgcctatttcggacatccatataaag

SEQ ID NO: 3197 - DNA, 373 bp, Classical swine fever virus
gtatacgaggttagttcattctcgtatgcatgattggacaaattaaaatttcaatttggatcagggcctccctccagcgacggccgaactgggctagccatgcccacagtaggactagcaaacggagggactagccgtagtggcgagctccctgggtggtctaagtcctgagtacaggacagtcgtcagtagttcgacgtgagcagaagcccacctcgatatgctatgtggacgagggcatgcccaagacacaccttaaccctagcgggggtcgctagggtgaaatcacaccacgtgatgggagtacgacctgatagggtgctgcagaggcccactattaggctagtataaaaatctctgctgtacatggcac

SEQ ID NO: 3198 - DNA, 373 bp, Classical swine fever virus
  PK15C
gtatacgaggttagttcattctcgtatgcattattggacaaatcaaaatttcaatttggttcagggcctccctccagcgacggccgaactgggctagccatgcccatagtaggactagcaaacggagggactagccgtagtggcgagctccctgggtgttctaagtcctgagtacaggacagtcgtcagtagttcgacgtgagcagaagcccacctcgagatgctatgtggacgagggcatgcccaagacgcaccttaaccctagcgggggtcgctagggtgaaatcacaccacgtgatgggagtccgacctgatagggtgctgcagaggctcactattaggctagtataaaaatctctgctgtacatggcac

SEQ ID NO: 3199 - DNA, 210 bp, Bat dicibavirus
gtatagcaccggaatggtattttactactccaagtatacgtactaggagttaaaccctgtaatttacaggggatttagtgacttttatccgtaaaagtcgattggacgttaatcggtaacgaggccaagtaccgtgaaccaatttaaaaacgtattttctcatgtggtagaaccaacttggaaatagcatggcatataggttgtttaggg

SEQ ID NO: 3200 - DNA, 504 bp, Rosavirus B
gtctctttagtgtctatgcttcagagagcggtgaactgacaccgttgcttcttgcacagcccttcgtgccggtctttccggttctcgacagcgttgggcatcatggctagttaggctaagatagtggatgatctagtgaacagttttggattgtttggagttttgtagcgatgctagtagtgtgtgtggacctccccacgtggtaacacgtgccccacaggccaaaagccaaggtgttgaaagcacccctactagtcccagactcacccatctgggaactcctctcatgaaaaatcttagtaacttttgattcggctattcatcaacctctctagtcaagggctgaaggatgcccggaaggtacccgcaggtaacgataagctcactgtggatctgatccggggctttggtgcgaccgtctgtccggcgtagccagagttaaaaaacgtctaggcccttccaccccaagggattggggtttccccaatcatttgaaagttcact

SEQ ID NO: 3201 - DNA, 675 bp, Encephalomyocarditis virus 1
  JZ1203
gtctgctcgatatcgcaggctgggtccgtgactacccactccccctttcaacgtgaaggctacgatagtgccagggcgggtactgccgtaagtgccaccccaaaacaacaacaaaccccccctaacattactggccgacgccgcttggaataaggccggtgtgcgtttgtctatatgttatttcccaccacattgccgtcttttggcaatgtgtgggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcggccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataat

SEQ ID NO: 3202 - DNA, 182 bp, Human Cosavirus F
gtcttaggacgacgcatgtggtatcccagcccccgcctacattggcgggggcttttgaagcaccagacactggatctgatcaggaggagggtagctgctttacagcccctcttaaaaattgcccaaggtccggccacccaacctaggggactaggttttccttttatttttaaattgtcatt

SEQ ID NO: 3203 - DNA, 282 bp, Hubei zhaovirus-like virus 1
gtgcaggatggcctttcccatcttaagtggtttgtaggatttcgtgggtccataccccccgatttcttggtacgtattccatgcacggagaatacgaccaaaactcttatttcaaaaaatattattttttactcttgtgggctgagtgcgacccaccagttccagcttagcaacctggaagttgttggagatttatggaaccaaattacacatgcgtggagtgccgccactccgtatctgttcactcattacgcgattaagttctgcgacgagacgagcgaa

SEQ ID NO: 3204 - DNA, 628 bp, Saffold virus
  5?93
gtgctatcatgcctccccgattatgtgatgttttctgccctgctgggcggagcattctcgggttgagaaaccttgaatctttttctttggaaccttggttcccccggtctaagccgcttggaatatgacagggttattttcttgatcttatttctacttttgcgggttctatccgtaaaaagggtacgtgctgccccttccttctctggagaattcacacggcggtctttccgtctctcaacaagtgtgaatgcagcatgccggaaacggtgaagaaaacagttttctgtggaaatttagagtgcacatcgaaacagctgtagcgacctcacagtagcagcggactcccctcttggcgacaagagcctctgcggccaaaagccccgtggataagatccactgctgtgagcggtgcaaccccagcaccctggttcgatgatcattctctatggaaccagaaaatggttttctcaagccctccggtagagaagccaagaatgtcctgaaggtaccccgcgtgcgggatctgatcaggagaccaattggcggtgctttacactgtcactttggtttaaaaattgtcacagcttctccaaaccaagtggtcttggttttccaattttgttga

SEQ ID NO: 3205 - DNA, 549 bp, Unknown
  Description of Unknown: CK1.0 sequence
gtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctgtcacg

SEQ ID NO: 3206 - DNA, 635 bp, Caprine kobuvirus
  5?40
gtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctcttgtgcctttctgctctggttcaagttccttgattgtttttgactgcttttcactgcttttcttctcacaatccttgctcagttcaaagtc

SEQ ID NO: 3207 - DNA, 513 bp, Caprine kobuvirus
  5?40/3?122
gtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactaaagtc

SEQ ID NO: 3208 - DNA, 549 bp, Caprine kobuvirus
  5?40/3?86_Distal
gtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgctgacaactcactgactatccacttgctctaaagtc

SEQ ID NO: 3209 - DNA, 513 bp, Caprine kobuvirus
  5?40/3? 122_Kozak
gtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactgccacc

SEQ ID NO: 3210 - DNA, 549 bp, Caprine kobuvirus
  5?40/3?86 Proximal
gtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactttcactgcttttcttctcacaatccttgctcagttcaaagtc

SEQ ID NO: 3211 - DNA, 549 bp, Unknown
  Description of Unknown: GLuc CK dCTG1 sequence
gtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctacgtctgacaactcactgactatccacttgctctaaagtc

SEQ ID NO: 3212 - DNA, 549 bp, Unknown
  Description of Unknown: GLuc CK dCTG1_2 sequence
gtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctacgtcgtacaactcactgactatccacttgctctaaagtc

SEQ ID NO: 3213 - DNA, 549 bp, Unknown
  Description of Unknown: GLuc CK dCTG1_2_3 sequence
gtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctacgtcgtacaactcacgtactatccacttgctctaaagtc

SEQ ID NO: 3214 - DNA, 549 bp, Unknown
  Description of Unknown: GLuc CK dAll sequence
gtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctacgtcgtacaactcacgtactactcactgtctctaaagtc

SEQ ID NO: 3215 - DNA, 635 bp, Caprine kobuvirus; identical to SEQ ID NO: 3206
  d40

SEQ ID NO: 3216 - DNA, 675 bp, Chicken picornavirus 1
gtggccgacttgcagaacttcctaccgaaccaccacctcacccccataactccttccctctacaccttccgctatggtggttaccactgctttattgccttgactgagaatggccaccccctcgacacctgccccctactgccccaccgcgcaaccttttgcttgtccactcggttggagaggcatgggggccccgttcatatccccagtccagttggtgaccttccccctccccgtccggtagatggtccagagggctttgccgacgccctctatgatgcttgcttgtctttcctccgtcagcgcgagcatgcacttgtcgagcccacggaaacacagcctagcttttgcttctctcaccctgcgtaccctgggcgccttccgctcgagattcgctttgttcgacaccctggcgtccccccaccgctacgtgattttactcgtggcatacaccgccctggcgttcagtacattccactgcctaatttgggtggcctccctcaatctcccgcaccccccattgcgcacgtcatcaccgccgccgctaacgcgatccggcgcggttctcactggcactgtcccctcgtccgccgggtttccactcatggttggcttttcacttattctggttactggtgttccatcctacttcatgatggtcgccatgaccatgac

SEQ ID NO: 3217 - DNA, 675 bp, Miniopterus schreibersii picornavirus 1
gttgtcgacccgttgcttggtttaagcatgaggtggattcccccgattatgtctacccgttactatggcgggcggtcgtttcagggtgtttctactgaggactgcaccaagtctttatcttttattctcagatctccggctgtttgacgcttgtaggacagcaggactattttctcttaatctttttctacccactagggtcctatcctagtggagggagggtgccaccccttctctctttagagagtgcgcctggcggtctttccgtctctggaaaaaggagcacatggcatgctacaattggcacaagaaaacaagctttgcggattctttctttgtactagaggaagctgtagcgaccctgtatggcgagcggactcccctctcggcgacgagagcctctcgggccaaaagccaagtgttaatagcacccatacaggcggcagtaccccactgccctttctcaacatacaatgactgatgaaccactgttggtttttctgacacctttgtagtaggattccaaggaatgtcctgaaggtaccctgttagcttacgcgcaggatctgatcaggagtctctttacagtgctgtacactgtgcaagggattaaaaattgtttgaggaatccccgagatagtggtctatctcttcctattttgttttacagacacg

SEQ ID NO: 3218 - DNA, 501 bp, Limnipivirus C
gtttctgagcactggtaagagcttagacaaacgtttttaaaatttattttctctgcaacttttgtttgtgtttatttttatttgttaattttgcgcctaagcatttgttgcgaagtatttgattcattagtaatattacttattgtttatttagatggtattcaaagtggtgggagtatcgaacccaagcgtcgtatgctatctccttgaacaatttttaatcattgcgaagtgatcattgaaaaggataggtgtttaagaactcaaagagtgttaataatgttgggtgacaggtgtccccatagaatttattaacatgatttggactggttatctagtaagaagaaccatcgaacgcacgagcgagcattgcttgcggggcagttaccctgcgtcgatgtaagtgtgtaccggggggtgcacatgttgattctttatggcctgatagggtgcgtcattcgcgcctagataattagtataatgcgaatggaataaatttac

SEQ ID NO: 3219 - DNA, 675 bp, Hunnivirus A1
taacgtttggcaagaaccctcacctgtcaattgggaccaccactttcagtgaccccatgcgaagtagtgagagagaataagctttcttacccttcatttgtgaacccttcagtcgaagccgcttggaataagataggaggaaaagttcattctaaatggagtgaaacatgtacttcagaatttctagcacgcgctgggctttcttgcgtgtgacggcactgtcttgccggagctctccacactgacaccccacgcttgtggaccttggtggcagatgacaacactgcagctggaattgagtgtctggtacactctgtgtaacagtgaaaacaatgtgatcacttcggtgagctagtagcctgtggaccaacaactggtaacagttgcctcaggggccaaaagccacggtgtttacagcaccctactggtttgattggagcaatccaagatgtcacagagttagtaattgccaagcagtccgtactggtatcttgacataccgtgcagttttggatagtgaaggatgccctgacggtacccataggtaacaagtgacactatggatctaagcaggggctcactctacgctgctttacagctggctgtgagttaaaaaacgtctagctatccacaacctaggggactaggttttccttttatttagattacaattat

SEQ ID NO: 3220 - DNA, 675 bp, Enterovirus AN12
taccgctgcaccagtgagctggtacgctagtaccttcgcacggagtagatggcatcccccaccccgtaacttagaagcaaagtacacatctggccaatagtggcgctgcatccagccgcgcaacggtcaagcacttctgtttccccggtccgcaagggtcgttatccgcccagtccactacggaaagcctactaaccattgaagctatcgagaggttgcgctcggccacgaccccggtggtagctctgagtgatggggctcgcaaacacccccgtggtaacacggatgcttgcccgcgcgtgcactcgggttcagcctattggttgttcacctcaacatagtgtaaatggccaagagcctactgtgctggattggttttcctccggagccgtgaatgctgctaatcccaacctccgagcgtgtgcgcacaatccagtgttgctacgtcgtaacgcgtaagttggaggcggaacagactactttcggtactccgtgtttcttttgttttattttgaattttatggtgacaattgctgagatttgcgaattagcgactctaccgctgaacattgccctgtactacctaatcgcatttcacaaaacctcagagataccaagctcttacattgatctgcttgttttcctgaatctcaaatataaattggaacaagcaaa

SEQ ID NO: 3221 - DNA, 675 bp, Unknown
  Description of Unknown: PV3 sequence
tacctttgtacgcctgttttatactccctcccccgcaacttagaagcatacaattcaagctcaataggagggggtgcaagccagcgcctccgtgggcaagcactactgtttccccggtgaggccgcatagactgttcccacggttgaaagtggccgatccgttatccgctcatgtacttcgagaagcctagtatcgctctggaatcttcgacgcgttgcgctcagcactcaaccccggagtgtagcttgggccgatgagtctggacagtccccactggcgacagtggtccaggctgcgctggcggcccacctgtggcccaaagccacgggacgctagttgtgaacagggtgtgaagagcctattgagctacatgagagtcctccggcccctgaatgcggctaatcctaaccatggagcaggcagctgcaacccagcagccagcctgtcgtaacgcgcaagtccgtggcggaaccgactactttgggtgtccgtgtttccttttattcttgaatggctgcttatggtgacaatcatagattgttatcataaagcgagttggattggccatccagtgtgaatcagattaattactcccttgtttgttggatccactcccgaaacgttttactccttaacttattgaaattgtttgaagacaggatttcagtgtcaca

SEQ ID NO: 3222 - DNA, 675 bp, Boone cardiovirus 1
tacgatcgctgtacattccactactgccaattagctcccccttcccgttgctcccctctataaggagagccttctcttgcaaaggtgaagccttcacccccggtcgaagccgcttggaataagacagggttattttctcctctcctcggcgcttgcctcttctaagctgaataggttctatctattcaggcggatggtctggtccgttccttcttggacagagtgtgtatctgggttttccggatctcgaccacacactcaccagagctcaggagtgattaagtcaaggcccgatctgcggcgaaaaggaaatgaagtattttgcagctgtagcgacctctcaaggccagcggatttccccacctggtgacaggtgcctctggggccaaaagccacgtgttaatagcacccttgagagcggtggtaccccaccaccctgcaaattatggatttgacttagtaactaaaagattgacttggcatacctcaacctgagcggcggctaaggatgccctgaaggtacccgtgttgaaatcgcttcggcgaccatggatctgatcaggggccctgcctggagtggttctatcccacacagcgtagggttaaaaaacgtctaaccgccccacaaagaccccggcagggatgccggtttcctttttaccaattcttgacact

SEQ ID NO: 3223 - DNA, 457 bp, Porcine sapelovirus
  JD2011
tacgcatgtattccacactcatttcccccctccacccttaaggtggttgtatccccataccttaccctcccttccacaatggacggacaaatggatttgacctcacggcaaacacatatggtatgatttcggatacaccttaacggcagtagcgtggcgagctatggaaaaatcgcaattgtcgatagccatgttagtgacgcgcttcggcgtgctcctttggtgattcggcgactggttacaggagagtaggcagtgagctatgggcaaacctctacagtattacttagagggaatgtgcaattgagacttgacgagcgtctcctcggagatgtggcgcatgctcttggcattaccatagtgagcttccaggttgggaaacctggactgggcctatactacctgatagggtcgcggctggccgcctgtaactagtatagtcagttgaaaccccccc

SEQ ID NO: 3224 - DNA, 608 bp, Kashmir bee virus
tacgtacaattttgacgcttcgttcatgcaacaatgaactcacatgtggcgctcggtagtaaccagaggggcgtcattcccccgtatggagtggagaatataagctaccgactcgagctgtagaataattcagcaacttataacgaacacgaattttagtcgacgaaaccattttagcctttaattctatgatttgattataatgataaacagctcatgtaactgtctaaactacataaatacaactggattacgaacctttaagtaactatcttagatgaagtctagtagtctcccaatatttccgtgaaaagaatgagggacgagatagctctatttaaagacgtgaggctttaaattctgataaatacattacctgagaattcctcctttaggagttagaatttgaaaagattagtacctatacttaatagaatttaaatatgttaataatgctgaagacaagtatttcgattattaacctctatatttctatataaagtatctgtgagtctcagtggacatcacagtaaggtcgcagttaacttgtaatcttttcattcctgtgtcggagcagtggtaatggagccggacgatttcgccaaaac

SEQ ID NO: 3225 - DNA, 675 bp, Unknown
  Description of Unknown: Aichivirus rat08 sequence
tactccattcagcttcttcggaacctgttcggaggaattaaacgggcacccactttcctgtcctctccccttttctgtaactccaagtgtgtgctcgtaatcttgactcccgcggattgaccgctccgctggtgaacaaactgctaggtcatctcctccccacccttgggcgtccttccgggcgtccacaccctccccccagcctgacgtgtcacaggctgtacaaagaccccgcgaaagctgctaacgtggcaattgtgggtcccccctttgtaaaggaaccgagtctttctcccttaaggctagacccctgtgtgaattcacaggtggcaactagtggttccactgcatgctcccgacctcggccgcggagtgctgttccccaagtcgtaacactgaccttcacttatgtgcctggcaagcatatctgagaagatgttccgctgtggctgccaaacctggtaacaggtgccccagtgtgcgtagtcttcttccgtcttcggacggtaggtgttaggtaaagatgcggcgtaaggttcaagtgccaacgccctggaagggatgacccttctactgccctaggaatgccgcgcaggtaccccaggttcgcctgggatctgagcgcgggctaattgtctacgggtagtttcatttccctcttcttccactggcatc

SEQ ID NO: 3226 - DNA, 675 bp, Unknown
  Description of Unknown: Aichivirus DV sequence
tactccattcagcttcttcggaacctgttcggaggaattaaacgggcacccatacacccccacccccttttctgcaacttaagtatgtgtgctcgtaatcttgactcccacggaacggatcgatccgctggagaacaaactgctagatccacatcctcccttcccctgggaggaccccggtcctcccacatcctccccccagcctgacgtaacacaggctgtgtgaagtccccgcgaaagctgctcacgtggcaattgtgggtccccccttcaccaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccaccttcgggtgggatctgagcctgggctaattgtctacgggtagtttcatttccaattcttttatgtcggagtc

SEQ ID NO: 3227 - DNA, 675 bp, Unknown
  Description of Unknown: Aichivirus DVI2169 sequence
tactccattcagcttcttcggaacctgttcggaggaattaaacgggcacccatacacccccacccccttttctgcaacttaagtatgtgtgctcgtaatcttgactcccacggaatggatcgatccgctggagaacaaactgctagatccacatcctcccttcccctgggaggaccccggtcctcccacatcctccccccagcctgacgtatcacaggctgtgtgaagtccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccaccttcgggtgggatctgagcctgggctaattgtctacgggtagtttcatttccaattcttttatgtcggagtc

SEQ ID NO: 3228 - DNA, 675 bp, Unknown
  Description of Unknown: Aichivirus KVGH sequence
tactccattcagcttcttcggaacctgttcggaggaattaaacgggcacccatactcccccccaccccccttttgtaactaagtatgtgtgctcgtgaccttgactcccacggaacggaccgatccgttggtgaacaaacagctaggtccacatcctcctttcccctgggagggtccccgccctcccacatcccccccccagcctgacgtgtcacaggctgtgtgaagcccccgcgaaagctgctcacgtggcaattgtgggtccccccttcatcaagacaccaggtctttcctccttaaggctagccccggcgtgtgaactcacgttgggcaactagtggtgtcactgtgcgctcccaatctcggccgcggagtgctgttccccaagccaaacccctggcccttcactatgtgcctggcaagcacacctgagaaggtgttccgctgtggctgccagcctggtaacaggtgccccagtgtgcgtaaccttcttccgtcttcggacggtggtgattggttaagatttggtgtaaggttcatgtgccaacgccctgtgcgggatgaaacctctactgccctaggaatgccaggcaggtaccccaccttcgggtgggatctgagcctgggctaattgtctacgggtggtttcatttccaattctttcatgtcggagtc

SEQ ID NO: 3229 - DNA, 497 bp, Unknown
  Description of Unknown: Ludopivirus sequence
tagacccccacctagcccttttccccgtcagtggggggcttactcactgggcatctgttaatctggcctaactagattgacaccactcccttggaacgtaactccacgctaactcactggctctacgcacagacacacggtctttctgctatccccggggaagataccagatggcgaccggctgtcccagcggcctagtagctactcgggttgagtacccaccacggttttgacgcctgctaaaattcaagagacagaggtaggggtgcttagtgtgtgggggaagttcccacaagcgaggcaaagcattgctccctcgcgtcaccgggtgcaaggtaaattggctggacttccgctctacccttgctactcgccctcttcggagggttcgaagtgacactaggtatacgcatggttgggaaaccatgcctggcctactactgggtgatagcctggcggcgggtccgtctcttggcttatacccgttgatttgggat

SEQ ID NO: 3230 - DNA, 675 bp, Unknown
  Description of Unknown: Kagoshima-2-24-KoV sequence
tatagtttgcctgtttctcgcaccgttaccgctcgttcgggaatgtgaaactggcacccctcctctcccctaccaccctttctccttcgcccccattcataatttacaacgccgcacacagcggcggccgccaagggctagcctggcggttataaaaggaacctgggtctttccctcttcaagccaaaaggtaggttccctgtgtccctgaatgctcggtgaggaatgctgcaccgtaacgctttgtgaagtgtttgcaagttctggcccggcaagcctacagagtgctgtgatccgctgcggacgccatcctggtaacaggacccccagtgtgcgcaacagtatgttcagacttcggtttgttcacttgctttcatggaccattgcgcgaaagtgcgtgcgccatatccctgtacttcaggtgtgcttctctggaccctaggaatgctgcgaaggtaccccgtttcggcgggatctgatcgcaggctaattgtctatgggttcagtttcctttttctttactccacaattgactgcttaactgactctggatcttgtgcttccactgctctttctgctctcaaaacggcttcacttaccaactctcacctttcgaccaacaccatttacacactaacttttttcgactcttctgactcctggcttggtgaagac

SEQ ID NO: 3231 - DNA, 709 bp, Unknown; identical to SEQ ID NO: 1360
  Description of Unknown: Salivirus NG-J1 sequence

SEQ ID NO: 3232 - DNA, 708 bp, Unknown; identical to SEQ ID NO: 1365
  Description of Unknown: Salivirus A BN2 sequence

SEQ ID NO: 3233 - DNA, 699 bp, Unknown; identical to SEQ ID NO: 1359
  Description of Unknown: Salivirus A GUT sequence

SEQ ID NO: 3234 - DNA, 675 bp, Mobovirus A
tattctcccacaaaccttcttgtaactctgttaagccttttacatccatgtaatttaattttctccacctaaaaggatttcccccatggtcctttttggctcgaacaaatgctacatagggtcttgttttctccccctggctctcttgccagggttccataccccaattcctctatttccatgatttttcatcatggtttatttttactgtcttcttattttctgaggtgaccaactcctaagccgactgggtcgcggaagcccggactcctcgcatcactagggtgcgtagcgatgtaggcgaaaatattggttgctagatgcatacatatagtgaattgatactacaccaaactctgttctttttgaaactagctattttctaagtaaggtaggctacgggtgaaaccttaccattgcaggtacgtgaaccgcaacggacatttggccgaagactggtgtacccacgtcagttataggacctcttcaacgttggtggacggcatgtcactgattagttaggctagtgaatttaagttcagggggtatcttttagcttaagcgtgtattctagtaggacttgcagagcctccccacctaggaggatctctgtttatagccccttttccttgttccgttagttttccacacttttacaatatttgatgatttgtt

SEQ ID NO: 3235 - DNA, 214 bp, Forest pouched giant rat arterivirus
tattggatccgcctccgggcaaaggttactttcttgtacctcggcttagccacagggtgaccccttgtacgtaggggccccgacgtagcactggtctgacaacaccttctcggcatttcaccttctgcccgctcttccgggcggtggtgtcaagaagcagcagtgctcttctcttttcttcctgcagttcaccgagccctacggggggtaggtg

SEQ ID NO: 3236 - DNA, 591 bp, Sakobuvirus A
  FFUP1 (1x mut)
tcacgcgcttttccggtggtcacccaccgttagggagcgccagcgttcgcgcttccgctaccaggtgacacactcctttcccctcccccattcccgttcccatcctctggactggtttctcctcacgattgaccagcagctgggagctgttaccagacgttggacagtaagtcccggatgcactatagggctggtggctagtgcttggtaagcactcaacgccatacctaatgtgtacctcggcttgccctcctggtcgtggtgaccggctgtttctcttcccttggctccagacgggctggtgtcctaccaccaccgttgcatgcagacctccccctgcgcactcgaacgccctgtcccagcagggttagtatgtgctgtgcagatctgcatgtgacaccccatccactggtagagcaggaagttgccctagctaacgcggcaagtattactttccgctacacgtccttgagattcctcggacctctggaactagggtgactgtgggcttgggaaaacccaccttggtcctgtactgcctgatagggtcgcggctggccgaccagtggatgtagccagttgttttgggat

SEQ ID NO: 3237 - DNA, 675 bp, Unknown
  Description of Unknown: EV K sequence
tcagcctgacgcaagtgcctccattggagtctctccaagccctccggggcttggagggcgccgaccccctgcctagggggagcccacgacacggctggagtccattggcacaccgcagccacgattcaagccagaattgaaagcgggaagcacttctgtctccccggtgtggatcatacgctgtacccacggcgaaaagtgaagcatcgttacccgactcggtacttcgagaagcccagtacagttgtggatctctgcagggtatacgctcagcgtgacccctacgtagttccttgagatggctgagagaacaccccacgggcgaccgtgtctctcggcgcgtggctcaaggccgggccttcagtggctcggtgccttgcagagtgaagcctccgaacagcctattgagctaccgtttagcctccgccctcttgaatgcggctaatcctaaccatggagcgcccgcccacagtccagtgggtagagcgtcgtaacgcgcaagtccgtggcggaaccgactactttagagtggcgtgtttccaatttatcctttataaagttgcttatggtgacaccacaagagatccacgatttcttgtttcttatcactgagacacaagtcatattcatcaatctttattgcggaattaacttggtgcgtccaaacacatcagc

SEQ ID NO: 3238 - DNA, 222 bp, Human pegivirus
  isolate JD2B1I
tcagggttggtaggtcgtaaatcccggtcaccttggtagccactataggtgggtcttaagagaaggttaagattcctcttgtgcctgcggcgagaccgcgcacggtccacaggtgttggccctaccggtgggaataagggcccgacgtcaggctcgtcgttaaaccgagcccgtcacccacctgggcaaacgacgcccacgtacggtccacgtcgcccttca

SEQ ID NO: 3239 - DNA, 675 bp, Human TMEV-like cardiovirus
tccgacgtggttggaattaacatcttttccgacgaaagtgctattatgcctccccgattgtgtgatgctttctgccctgctgggcggagcgtcctcgggttgagaaaccttgaatcttttcctttggagccttggctcccccggtctaagccgcttggaatatgacagggttattttccaaactctttatttctactttcatgggttctatccatgaaaagggtatgtgttgccccttccttctttggagaatctgcgcggcggtctttccgtctctcaacaggcgtggatgcaacatgccggaaacggtgaagaaaacagttttctgtggaaatttagagtggacatcgaaacagctgtagcgacctcacagtagcagcggattcccctcttggcgacaagagcctctgcggccaaaagccccgtggataagatccactgctgtgagcggtgcaaccccagcaccctggttcgatggccattctctatggaaccagaaaatggttttctcaagccctccggtagagaagccaagaatgtcctgaaggtaccccgcgcgcgggatctgatcaggagaccaattggcagtgctttacgctgccactttggtttaaaaactgtcacagcttctccaaaccaagtggtcttggttttccaattttgttgactgacaat

SEQ ID NO: 3240 - DNA, 650 bp, Salivirus A; identical to SEQ ID NO: 1364
  SZ1

SEQ ID NO: 3241 - DNA, 653 bp, Unknown
  Description of Unknown: SV1.0 sequence
tctgtcctcaccccatcttcccttctttcctgcaccgttacgcttactcgcatgtgcattgagtggtgcacgtgcttgaacaaacagctacactcacatgggggcgggttttcccgccctgcggcctctcgcgaggcccacccctccccttcctcccataactacagtgctttggtaggtaagcatcctgatcccccgcggaagctgctcacgtggcaactgtggggacccagacaggttatcaaaggcacccggtctttccgccttcaggagtatccctgctagtgaattctagtagggctctgcttggtgccaacctcccccaaatgcgcgctgcgggagtgctcttccccaactcaccctagtatcctctcatgtgtgtgcttggtcagcatatctgagacgatgttccgctgtcccagaccagtccagtaatggacgggccagtgtgcgtagtcgtcttccggcttgtccggcgcatgtttggtgaaccggtggggtaaggttggtgtgcccaacgcccgtactttggtgatacctcaagaccacccaggaatgccagggaggtaccccgcttcacagcgggatctgaccctgggctaattgtctacggtggttcttcttgcttccacttctttctactgttcgccacc

SEQ ID NO: 3242 - DNA, 650 bp, Salivirus sp.; identical to SEQ ID NO: 1364
  SZ1

SEQ ID NO: 3243 - DNA, 675 bp, Lesavirus 2
tctttctttattttcttatgtaactcttctttttaagttttattttgcctacttgtgagcttatgcgggaccactgtcttagacaaccccacatttgtcatgagtaagtacacgcaaccattacgattactttttaaccgtctgaccttttgataacaactgaagttaggcgtgaaacatgcatttataccaaagtagccccgcatttccccactacggtgggggggctaccctactggctttggaactgtagccattatgtgttgcctggctttcaggatctcacaacacaacagttctctcacaatggaatatgggtgagattgcagtgacatgaacaagtatctagtagtacatagactcaagcctagttgcctgcggaacaacatgtggtaacacatgccccagggtccaaaagacaagggttaacagccccttctaggtgtctgtgtgtgaagaatactttagtagtgttgttatgatctcacctgttagtacagaatgagtatggcttggtgaaggatgtcctacaggtacccattatatggatctgagtaggagaccactagtggtggctttaccgccaggtgagtggtttaaaaagcgtctagccaagccaacagcactagggatagtgctttctatattttatattttcagtgtatatggtgacaa

SEQ ID NO: 3244 - DNA, 675 bp, Didelphis aurita
  HAV
tctttggtctggggaactaaaataccagacccgcgtttgcctagcgatataggctttaattgttgtttgtcattgtgcgtttgatatgtgttttaatgtaaataataattctagcaggttctagttcttgatcatgtcctctttaaggcactcatttcaacttgctatctttcttttcttccttggttctccctacaccaaatgcactggccgctgcgcccggcggggtcaaccacatgattagcatgtggctgtaggtgttgaaggctgggacatgaacatcaatggaatagtgcgcatgcttactggggtccattgaagtagtgggatctttctattggggtaggctacgggtgaaaccccttaggttaatactcatattgagagataccttggataggttaactgtgctggatatggttgagtttaacgacaaaaagccatcaacagctgtggacagaacctcatccttagattgctcactatggatatgtgctctgggcgtgtttcttgcatgatggccattggtcaattcatgcctgggccaatgtaggattagccttaaattactttttaaaagtagcctcatttagctggactaatggtggggcgtatgatcctgcatttggcctctggggtaatcaggggcatttaggtttccacataatagcaaat

SEQ ID NO: 3245 - DNA, 420 bp, Pasivirus A
  (longer)
tgaaaaagtggttgtgcagctggattttccggctgtgcaactgcttttgaccagtggctctgggttacttagccaaattcctttcccttatccctattggtttgtgttgtgtgttgtttgttttgttttgtcttaactatatacaagatccttcccgccgatacagacctcgacagtctggtgtaggagggttggtgttattaatttgccccaaaagagtgaccgtgacacgtggaaaccatgagtacatgtgtatccgtggaggatcgcccgggactggattccatatcccattgccatcccaacaaacggagggtatacccaccacgtgcgcgtttgcagtgggaatctgcaaatttagtcatactgcctgatagggtgtgggcctgcactttggggtactcaggctgtttatataat

SEQ ID NO: 3246 - DNA, 618 bp, Unknown
  Description of Unknown: Parabovirus 3?60 sequence
tgaaccgttacgcaccactcagttggtgtttggtggcaccaatgatggaacaaaaggctacaccacttgggctacggcccgcgccaccttgtggcgcaaagacattagaagaatagcataccgcccactagggccctgcagccagcagggtaacgggcaagcacttctgtctccccggtagaacggtataggctgtacccacggccgaaaactgaactatcgttacccgactccgtacttcgcaaagcttagtaggaaactggaaagttcgagttattgacccggagtgttccccccactccagaaacgcgtgatgagggttgccaccccgaccatggcgacatggtgggcatccctgcgctggcacgcggcctctaagaggataactcgctcctactggtaaccgaagagccccgtgagctacggtttattcctccgcctccctgaatgcggctaatcctaacccatgagcagttgccatagatccatatggtggactgtcgtaacgcgtaagttgtgggcggaaccgactactttgggatggcgtgtttccttgttttctccatttgttgttgtatggtgacaagttatagatctcgatctatagcgtttgtaagg

SEQ ID NO: 3247 - DNA, 350 bp, GB virus C
  Iowa
tgacgtgggggggttgatccgccccccccggcactcggtgcaagccccataaaccgacgcctatctaagtagacgcaatgactcggcgccgactcggcgaccggccaaaaggtggtggatgggtggtgacagggttggtaggtcgtaaatcccggtcatcctggtagccactataggtgggtcttaagagaaggtcaagactcctcttgtgcctgcggcgagaccgcgcacggtccacaggtgctggccctaccggtgtgaataagggcccgacgtcaggctcgtcgttaaaccgagcccgtcacccacctgggcaaacgacgcccacgtacggtccacgtcgcccttca

SEQ ID NO: 3248 - DNA, 281 bp, GB virus C
  GT110
tgacgtgggggggttgattttccccccccggcactgggtgcaagccccagaaaccgacgcctatctaagtagacgcaatgactcggcgccgactcggcgaccggccaaaaggtggtggatgggtgatgacagggttggtaggtcgtaaatcccggtcatcctggtagccactataggtgggtcttaagagaaggtcaagattcctcttacgcctgcggcgagaccgcgcacggtccacaggtgttggccctaccggtgtgaataagggcccgacatcaggc

SEQ ID NO: 3249 - DNA, 445 bp, Grusopivirus A
tgcctgagtaggattgtgaatttaggtatgagagggttagccaacccattctgaaccataatagatacgtcaatctgaatccatctaaatctatctcttaggcagtggtgctgaaatattgcaagctactagggatagacgtgatctgattcaagaacctatctaatgtggtgatgagaaggctaggtttatccatagtaatcccttgttctgaacaggcaatgcacatgctctagtaggatctcgggctctgcgattggctctaaaccgaccaatccaggtagaggcactaagtgtaggacttgccaaaatgtattacatgctggtaccgactcactagtctggaaactccacactgaaagtgactggggggggccccatcacatttgtgctactgcttgatagagttgcggctggtcaacttggattggtataaccagttgaa

SEQ ID NO: 3250 - DNA, 611 bp, Unknown
  Description of Unknown: Parabovirus 5?67 sequence
tgggctacggcccgcgccaccttgtggcgcaaagacattagaagaatagcataccgcccactagggccctgcagccagcagggtaacgggcaagcacttctgtctccccggtagaacggtataggctgtacccacggccgaaaactgaactatcgttacccgactccgtacttcgcaaagcttagtaggaaactggaaagttcgagttattgacccggagtgttccccccactccagaaacgcgtgatgagggttgccaccccgaccatggcgacatggtgggcatccctgcgctggcacgcggcctctaagaggataactcgctcctactggtaaccgaagagccccgtgagctacggtttattcctccgcctccctgaatgcggctaatcctaacccatgagcagttgccatagatccatatggtggactgtcgtaacgcgtaagttgtgggcggaaccgactactttgggatggcgtgtttccttgttttctccatttgttgttgtatggtgacaagttatagatctcgatctatagcgtttcttgagagatttccaaacatttattcaagtcgtacaattcttgtgtttaagcagtacagtgtaagg

SEQ ID NO: 3251 - DNA, 318 bp, Pegivirus A
  1220
tgtagcaatgcgcatattgctacttcggtacgcctaattggtaggcgcccggccgaccggccccgcaagggcctagtaggacgtgtgacaatgccatgcgggatcatgacactggggtgagcggaggcagcaccgaagtcgggtgaactcgactcccagtgcgaccacctggcttggtcgttcatggagggcatgcccacgggaacgctgatcgtgcaaagggatgggtccctgcactggtgccatgcgcggcaccactccgtacagcctgatagggtggcggcgggcccccccagtgtgacgtccgtggagcgcaac

SEQ ID NO: 3252 - DNA, 675 bp, Tropivirus A
tgtcgcatgttgccaacatcaaaattctgggagagtcgcgaactccttaacactgccttgcctcgacggagccgttgttatagtgtcgacgggatacaaacattaaactaaacccacttgcctcgacggaaccccttaccttttattttattttatagtatgaaagtgaatcttgtatgaatgttcatagaaaactgcaaatgagtaccacgtctaacatgagagaatgatactggagaaatccaagtttagaagtcactacgaatcccagcggaaacaagggaattctgagcttctaataggcgtttaagactatttgcaaaattctggtgcgtaagtgatattttcattgcgtagaacgctggtaaccactccggctagtataagcattgttagtcacttattatgaaactccacactatcctttctggagaagcacacaaacttacatggtaaagctagaccattatcttaagcggtgagtacactgcaaccttgtaacaatgcttgtatgactactttttgtatatcttgagcaatattgttgaggtggacatgtccaaaggtaatgttgttgggaatggaggggtccattttcccgtgcacgtagtgtactagtattgggtgatagccttgcggcggatcaaccatgtattttaatccgttgactttcac

SEQ ID NO: 3253 - DNA, 675 bp, Unknown
  Description of Unknown: EV A114 sequence
tgtgcgcctgttttgaaaccccctcccccaactcgaaacgtagaagtaatgtacactactgatcagtagcaggcgtggcgcaccagccatgtctcgatcaagcacttctgtttccccggactgagtatcaatagactgctcacgcggttgaaggtgaaaacgtccgttacccggctaactacttcgagaaacctagtagcaccatagaaactgcagagtgtttcgctcagcacttcccccgtgtagatcaggtcgatgagtcactgcaatccccacgggtgaccgtggcagtggctgcgttggcggcctgcctatggggcaacccataggacgctctaaggtggacatggtgtgaagagtctattgagctagttagtagtcctccggcccctgaatgcggctaatcctaactgtggagcgcatactcccaaaccagggagcagtgcgtcgtaacgggcaactccgcagcggaaccgactactttgggtgtccgtgtttccttttattcctatactggctgcttatggtgacaattgagagattgttaccatatagctattggattggccatccagtgtgtaatagagcaatcatttaccaatttgttggatttactccattaacccacacgtctctcaacacactacatttcatcttactactgaacactagaaa

SEQ ID NO: 3254 - DNA, 348 bp, Dianke virus
tgttttcaaccataatactactactacaagtataaaaccccgtccgtctgtcggagacgctaaactctgaccaccaatctagccacatcagttgcttaaagaacctcttgagacactctcccacttaacatcttttaggaatcttcgatgctacaacaacttggctagtgaacaataaatccgtacaattcacagttgtaagaggccataggtccagactttgaaaggtttgtttctattgttacaaatacttagattaacagaggctatttaatagtgctcatcacgttaacagagtaaccttgtgcaatagtatgagcttgttgtaaaacgtcttgatacgacacc

SEQ ID NO: 3255 - DNA, 741 bp, Unknown
  Description of Unknown: CVB3 sequence
ttaaaacagcctgtgggttgatcccacccacaggcccattgggcgctagcactctggtatcacggtacctttgtgcgcctgttttataccccctcccccaactgtaacttagaagtaacacacaccgatcaacagtcagcgtggcacaccagccacgttttgatcaagcacttctgttaccccggactgagtatcaatagactgctcacgcggttgaaggagaaagcgttcgttatccggccaactacttcgaaaaacctagtaacaccgtggaagttgcagagtgtttcgctcagcactaccccagtgtagatcaggtcgatgagtcaccgcattccccacgggcgaccgtggcggtggctgcgttggcggcctgcccatggggaaacccatgggacgctctaatacagacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcctatactggctgcttatggtgacaattgagagatcgttaccatatagctattggattggccatccggtgactaatagagctattatatatccctttgttgggtttataccacttagcttgaaagaggttaaaacattacaattcattgttaagttgaatacagcaaa

SEQ ID NO: 3256 - DNA, 651 bp, Unknown
  Description of Unknown: CVB3 3?91 sequence
ttaaaacagcctgtgggttgatcccacccacagggcccattgggcgctagcactctggtatcacggtacctttgtgcgcctgttttataccccctcccccaactgtaacttagaagtaacacacaccgatcaacagtcagcgtggcacaccagccacgttttgatcaagcacttctgttaccccggactgagtatcaatagactgctcacgcggttgaaggagaaagcgttcgttatccggccaactacttcgaaaaacctagtaacaccgtggaagttgcagagtgtttcgctcagcactaccccagtgtagatcaggtcgatgagtcaccgcattccccacgggcgaccgtggcggtggctgcgttggcggcctgcccatggggaaacccatgggacgctctaatacagacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcctatactggctgcttatggtgacaattgagagattgttaccatatagctattggattggccatccggtgaagcaaa

SEQ ID NO: 3257 - DNA, 741 bp, Unknown
  Description of Unknown: CVB1 sequence
ttaaaacagcctgtgggttgttcccacccacaggcccattgggcgctagcactctggtatcacggtacctttgtgcgcctgttttacatcccctccccaaattgtaatttagaagtttcacacaccgatcattagcaagcgtggcacaccagccatgttttgatcaagcacttctgttaccccggactgagtatcaatagaccgctaacgcggttgaaggagaaaacgttcgttacccggccaactacttcgaaaaacctagtaacaccatggaagttgcggagtgtttcgctcagcactaccccagtgtagatcaggtcgatgagtcaccgcgttccccacgggcgaccgtggcggtggctgcgttggcggcctgcctacggggaaacccgtaggacgctctaatacagacatggtgcgaagagtctattgagctagttggtaatcctccggcccctgaatgcggctaatcctaactgcggagcacataccctcaaaccagggggcagtgtgtcgtaacgggcaactctgcagcggaaccgactactttgggtgtccgtgtttcattttattcctatactggctgcttatggtgacaattgacaggttgttaccatatagttattggattggccatccggtgactaacagagcaattatatatctctttgttgggtttataccacttagcttgaaagaggttaaaacactacatctcatcattaaactaaatacaacaaa

SEQ ID NO: 3258 - DNA, 744 bp, Echovirus
  E14
ttaaaacagcctgtgggttgttcccatccacagggcccactgggcgccagcactctggtattgcggtaccttagtgcgcctgttttatatacccgtcccccaaacgtaacttagacgcatgtcaacgaagaccaatagtaagcgcagcacaccagctgtgttccggtcaagcacttctgttaccccggaccgagtatcaataagctactcacgtggctgaaggagaaaacgttcgttacccgaccaattacttcaagaaacctagtaacaccatgaaggttgcgcagtgtttcgctccgcacaaccccagtgtagatcaggtcgatgagtcaccgcattccccacgggtgaccgtggcggtggctgcgctggcggcctgcccatggggaaacccatgggacgcttcaatactgacatggtgcgaagagtctattgagctaattggtagtcctccggcccctgaatgcggctaatcctaactgcggagcagatacccacacaccagtgggcagtctgtcgtaacgggcaactctgcagcggaaccgactactttgggtgtccgtgtttctctttatccttatactggctgcttatggtgacaattgagagattgttaccatatagctattggattggccatccggtgacaaatagagcaattgtgtatttgtttgttggtttcgtgccattaaattacaaggttctaaacacccttaatcttattatagcattcaacacaacaaa

SEQ ID NO: 3259 - DNA, 628 bp, Unknown; identical to SEQ ID NO: 754
  Description of Unknown: HRV14 sequence

SEQ ID NO: 3260 - DNA, 726 bp, Enterovirus D
ttaaaacagctctggggttgttcccaccccagaggcccacgtggcggctagtactccggtaccccggtacccttgtacgcctgttttatactccctttcccaagtaactttagaagaaataaactaatgttcaacaggagggggtacaaaccagtaccaccacgaacacacacttctgtttccccggtgaagttgcatagactgtacccacggttgaaagcgatgaatccgttacccgcttaggtacttcgagaagcctagtatcatcttggaatcttcgatgcgttgcgatcagcactctaccccgagtgtagcttgggtcgatgagtctggacaccccacaccggcgacgtggtccaggctgcgttggcggcctacccatggctagcaccatgggacgctagttgtgaacaaggtgcgaagagcctattgagctacctgagagtcctccggcccctgaatgcggctaatcccaaccacggagcaaatgctcacaatccagtgagtggtttgtcgtaatgcgcaagtctgtggcggaaccgactactttgggtgtccgtgtttccttttatttttattatggctgcttatggtgacaatctgagattgttatcatatagctattggattagccatccggtgatatcttgaaattttgccataactttttcacaaatcctacaacattacactacactttctcttgaataattgagacaactcata

SEQ ID NO: 3261 - DNA, 626 bp, Human rhinovirus 1
ttaaaactgggtgtgggttgttcccacccacaccacccaatgggtgttgtactctgttattccggtaactttgtacgccagtttttccctcccctccccatccttttacgtaacttagaagttttaaatacaagaccaatagtaggcaactctccaggttgtctaaggtcaagcacttctgtttccccggttgatgttgatatgctccaacagggcaaaaacaacagataccgttatccgcaaagtgcctacacagagcttagtaggattctgaaagatctttggttggtcgttcagctgcatacccagcagtagaccttgcagatgaggctggacattccccactggtaacagtggtccagcctgcgtggctgcctgcgcacctctcatgaggtgtgaagccaaagatcggacagggtgtgaagagccgcgtgtgctcactttgagtcctccggcccctgaatgcggctaaccttaaacctgcagccatggctcataagccaatgagtttatggtcgtaacgagtaattgcgggatgggaccgactactttgggtgtccgtgtttcactttttcctttattaattgcttatggtgacaatatatatattgatatatattggcatc

SEQ ID NO: 3262 - DNA, 302 bp, Unknown
  Description of Unknown: Bat Hp-betacoronavirus sequence
ttaagcttcggcttgttgcataggaccggaaaggtactatctaccctaactcttgtagttagactctctaaacgaactttaaaactggttgtgtccttcagtagtctgtatggccattggaggcacaccggtaattatcaaatactaagaagattcatagtacatccttgtctagcttttggttggcagtgagcctacggtttcgtccgtgtcgctcacaattatccacacagtaggtttcgtccgctgtggttgagttgctagtccgttgctgtttcgtcagccatctacaactcgacacc

SEQ ID NO: 3263 - DNA, 675 bp, Apodemus agrarius picornavirus
  strain Longquan-Aa118
ttactcagcgtaactactccgggttacgtgatgaagaagaggctacggagattctcgggctacggccctggagccactccggctcctaaagatttagaagtttgagcacacccgcccactagggccccccatccaggggggcaacgggcaagcacttctgtttccccggtatgatctgataggctgtaaccacggctgaaacagagattatcgttatccgcttcactacttcgagaagcctagtaatgatgggtgaaattgaatccgttgatccggtgtctcccccacaccagaaactcatgatgagggttgccatcccggctacggcgacgtagcgggcatccctgcgctggcatgaggcctcttaggaggacggatgatatggatcttgtcgtgaagagcctattgagctagtgtcgactcctccgcccccgtgaatgcggctaatcctaaccccggagcaggtgggtccaatccagggcctggcctgtcgtaatgcgtaagtctgggacggaaccgactactttcgggaaggcgtgtttccatttgttcattatttgtgtgtttatggtgacaactctgggtaaacgttctattgcgtttattgagagattcccaacaattgaacaaacgagaactacctgttttattaaatttacacagagaagaattaca

SEQ ID NO: 3264 - DNA, 675 bp, Unknown
  Description of Unknown: Aichivirus ETHP4 sequence
ttactccattcagcttcttcggaacctgttcggaggaattaaacgggcacccatacacccccaccccctttttgcaacttaagtatgtgtgctcgtgatcttgactcccacggaatggatcgatccgctggagaacaaactgctagatccacatcctcccttcccttgggaggacctcggtcctcccacatcctccccccagcctgacgtaccacaggctgtgtgaagcccccgcgaaagccgctcacgtggcaattgtgggtccccccttcattaagacaccaggtctttcctccttaaggctagtcccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtcttcggacggtagtgattggttaagatttggcgtaaggttcatgtgccaacgccctgtgcgggatgaaacctctactaccctaggaatgccaggcaggtaccccaccctcgggtgggatctgagcctgggctaattgtctacgggtagtttcatttccaattcttctatgtcggagtc

SEQ ID NO: 3265 - DNA, 675 bp, Kobuvirus sp.
  16317
ttactccattcagcttcttcggaacctgttcggaggaattaaacgggcacccatacacccccatcccctttctgcaacttaagtatgtgtgctcgtgatcttgactcccacggaatggatcgatccgctggagaacaaactgctagatccacatcctcccttcccctgggaggaccttggtcctcccacatcctccccccagcctgacgtaccacaggctgtgtgaagcccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatacctgagaaggtgttccgctgtggctgccagcctggtaacaggtgccccagtgtgcgtaaccttcttccgtcttcggacggtagtgattggttaagatttggtgtaaggtccatgtgccaacgccctgtgcgggatgaaacctctactgccctaggaatgccaggcaggtaccccacccccgggtgggatctgagcctgggctaattgtctacgggtagtttcatttccaattcttttatgtcggagtc

SEQ ID NO: 3266 - DNA, 675 bp, Unknown
  Description of Unknown: Aichivirus Chshc7 sequence
ttactccattcagcttcttcggaacctgttcggaggaattaaacgggcacccatacatccccatcccctttctgtaacttaagtatgtgtgcttgtaatcttgactcccacggaatggatcgatccgctggagaacaaactgctagatccacatcctcccttcccctgggaggaccttggtcctcccacatcctccccccagcctgacgtaccacaggctgtgtgaagcccccgcgaaagctgctcacgtggcaattgtgggtccccccttcatcaagacaccaggtctttcctccttaaggctagccccgatgtgtgaattcacattgggcaactagtggtgtcactgtgcgctcccaatctcggccgcggagtgctgttccccaagccaaacccctggcccttcactatgtgcctggcaagcatatctgagaaggtgttccgctgtggctgccagcctggtaacaggtgccccagtgtgcgtaaccttcttccgtctccggacggtagtgattggttaagatttggtgtaaggttcatgtgccaacgccctgtgcgggatgaaatctctactgccctaggaatgccaggcaggtaccccaccctcgggtgggatctgagcctgggctaattgtctacgggtagtttcatttccaatccttttatgtcggagtc

SEQ ID NO: 3267 - DNA, 675 bp, Unknown
  Description of Unknown: A73-675 sequence
ttactccattcagcttcttcggaacctgttcggaggaattaaacgggcacccatactccccccaccccccttttgtaactaagtatgtgtgctcgtgatcttgactcccacggaacggaccgatccgttggtgaacaaacagctaggtccacatcctcccttcccctgggagggcccccgccctcccacatcctccccccagcctgacgtatcacaggctgtgtgaagcccccgcgaaagctgctcacgtggcaattgtgggtccccccttcatcaagacaccaggtctttcctccttaaggctagccccggcgtgtgaattcacgttgggcaactagtggtgtcactgtgcgctcccaatctcggccgcggagtgctgttccccaagccaaacccctggcccttcactatgtgcctggcaagcatatctgagaaggtgttccgctgtggctgccaacctggtgacaggtgccccagtgtgcgtaaccttcttccgtctccggacggtagtgattggttaagatttggtgtaaggttcatgtgccaacgccctgtgcgggatgaaacctctactgccctaggaatgccaggcaggtaccccacctccgggtgggatctgagcctgggctaattgtctacgggtagtttcatttccaatccttttatgtcggagtc

SEQ ID NO: 3268 - DNA, 675 bp, Unknown
  Description of Unknown: EV I sequence
ttagtactttctcacggggatagtggtatccctccctagtaatttagaagacttgaaaaaccgaccaataggcacctcgcatccagcggggtaaaggtcaagcacttctgtttccccgggtcgagtagcgatagactgtgcccacggtcgaaggtgaaacaacccgttatccgactttgtacttcgggaagcctagtaccaccaaagattatgcttggggtttcgctcagcacgaccctggtgtagatcaggccgatggatcaccgcattcctcacaggcgactgtggcggtggtcgcgtggcagcctgccgatggggcaacccatcggacgccaagcatatgacagggtgtgaagagcctactgagctacaaagtattcctccggcccctgaatgcggctaatcccaaccacggagcatttgctaccaaaccaggtagtggaatgtcgtaacgggtaactctgtggcggaaccgactactttgggtgtccgtgtttccttttaatttatcattctgtatatggtgacaactatagtgctatctcgatttgcattactattgttgagattaaaactttattacattgttgcattttaccctttgagtgagttttcacctgaacagattaatttactcatcctgtttatatattacaagcagaaatacttgcaaag

SEQ ID NO: 3269 - DNA, 549 bp, Rodent hepatovirus
ttcaaagaggggtccgggattttcctggtccccctctttgggcacccttggctcgggggtgtgaataccgtgctcgcgtttgccgtgcgttaacggcttcatttatgtttgtttgtctgttttattatgttggtttgtctgtttgttatgttggtattgttcgtgtttaatgttatgaccacattacactccagccaatgaagaacagatggtgcggttattgctggcggaattcctaacgtcctggatccgttggtacgcatcacaaaacaatttgcagagagagtggtgaaacggcttgggaatccctgagtacagggaaatcacactgatagctcatcttggctgttttcagtcatggaccttatgcagtgtaatttgggtgtaccccccatagcttaggaggaatgttctgtcttggcactagagtgggacgctgatgcctccgtgtctaggatggtctaagggacagaatggggtgcctctgatgccatactacctgatagggtgctctcacggcctctgcatcttagtgagaagttcaatttt

SEQ ID NO: 3270 - DNA, 734 bp, Hepatitis A Virus
  HA16
ttcaagaggggtctccggagttttccggaacccctcttggaagtccatggtgaggggacttgatacctcaccgccgtttgcctaggctataggctaaatttccctttccctgtccttcccctatttccttttgttttgtttgtaaatattaattcctgcaggttcagggttctttaatctgtttctctataagaacactcaatttttcacgctttctgtctcctttcttccagggctctccccttgccctaggctctggccgttgcgcccggcggggtcaactccatgattagcatggagctgtaggagtctaaattggggacgcagatgtttgggacgtcgccttgcagtgttaacttggctttcatgaacctctttgatcttccacaaggggtaggctacgggtgaaacctcttaggctaatacttcaatgaagagatgccttggatagggtaacagcggcggatattggtgagttgttaagacaaaaaccattcaacgccggaggactggctctcatccagtggatgcattgagggaattgattgtcagggctgtctctaggtttaatctcagacctctctgtgcttagggcaaacactatttggccttaaatgggatcctgtgagagggggtccctccattgacagctggactgttctttggggccttatgtggtgtttgcctctgaggtactcaggggcatttaggtttttcctcattcttaaataata

SEQ ID NO: 3271 - DNA, 251 bp, Hubei tombus-like virus 32
ttcgggtttacccgcgtaagcggccacactgactggttgtcggtgttgaatttgtataccagatgaggagacgttaccaccgtctcggcagtgctacgtctgggaaaggactgtgatagtggacagtcctaccgtctttagatacattgcgttgtgtatagcccgggagggattaactaatagcaacgcaatgcacacggcggttcggatttgcttgactgatggaaagacatctaagttctaattgaacc

SEQ ID NO: 3272 - DNA, 624 bp, Salivirus A; identical to SEQ ID NO: 1368
  CH

SEQ ID NO: 3273 - DNA, 675 bp, Limnipivirus A
ttctttggatatccatttaacgtgtaccctatacgataattggggtggattctggatgcctagttccagtgattggttaagaactcgtttactacgtatagtatgattagcaaagtgctcgattgatcacgtaatgatctatgtggttaaaaacccagtagtatggtatatactcagtagtgtacactgtgagtacaactcttggcgtagagagaacaattcacccgaatccgtggcgtatccatggaaataagtttacctaattgtatgttacaaggcatatgagacatttatgagatatggtttattttgactaaacgagtgtagaggtggtggagtctatccaacttcaagccatgcaattgttgtgttgattgatatcattgaccatttttgtggattgtgtacacatacaatttgaaaattaaccccctcaagaataagacatgggaccattcgtggtagataccgtgctcggatgcttgagattagatgggttagactagttttggaatgagattgccgagaaagtcccgctagacatgttttacaagtcgtggtattccgctagactttttcgcagacacatggaagggtccatgtgttgtgcaattgcagggtgacagcccaactgcagagttttccttactagaataaaaatctgttgtcaatttt

SEQ ID NO: 3274 - DNA, 604 bp, Unknown; identical to SEQ ID NO: 656
  Description of Unknown: Aalivirus sequence

SEQ ID NO: 3275 - DNA, 489 bp, Porcine Sapelovirus A2; identical to SEQ ID NO: 513

SEQ ID NO: 3276 - DNA, 675 bp, Sclerotinia sclerotiorum
  dsRNA mycovirus-L
ttgaattaatcttttacgtttacgcgcataaaatcaggacacatctcttgtatactttagtatatcaatgatgtttttgttttatgcgattaatcgtaagagaacttctttccatccgcctgtatgggcgggataataagttcaccgccttggtcgaggcgcaaacttgtatgtgcaaaggtgagctatatgctcgaaatagtcgtaactaacacacagccactacctgtagagctctattgatccggaatcctttagtgggaatgcagagctcacaccggacctgcgggtatcttcggcgttagggacttctgtttcagccttgaatcatttacctttataccttctctgaggcgcctgggccgggcgcgatattaagtacaagtcaaggacatcgcgggtagtggtctaatcagccgctagtcctgctggagagttccaacttagttgggtgtggtgcatactagctggatagagtaggtatgtattgctaacgtatgccggaggctatccgtcctcggtagaacgtgccgaggagtagtctctgcagacccccgaacgcgtggggtctttacttaaatgtaggcggagggagcgctcgtaggtggaacgactgcctcccagtcgaatgcaagattttgcacgcggaccagtctgcccggcaattcccgggtg

SEQ ID NO: 3277 - DNA, 608 bp, Kobuvirus sp.
  SZAL6 5?158
ttgactccaggcggatgttgtgtcgcccgtcctgtgaacaaacagctagacactttcctcccctccctctgggctgctccggcagtccactccctccccccagcgtaacatgccccgctggagtgatgcacctggaagtcgtggacgtgggttagtaacttcggtgaaaacccactataatgacaactggttgacccccacactcaaaggactcgagtctttctcccttaaggctagcccggccacatgaatttgcagctggcaactagtgagtccaccatgtcccgcaacctcggctgcggagtgctgttccccaagcgtatgccttccttctgtaagagtgcgcctggcaagcacatctgagaagtcgttccgctgcgtcgtgccaacctggcgacaggtgacccagtgtgcgtagacttcttccggattcgtccggctcttctctaggaaacatgcgtgtaaggttcatgtgccaaagccctgcgcgcggtgttcttctactgccctaggaatgtgccgcaggtacccctacttcggtagggatctgagcggtagctaattgtctacgggtagtttcatttccatcttctcttcaggtcgacatc

SEQ ID NO: 3278 - DNA, 697 bp, Encephalomyocarditis virus
  EMCV-Cf
ttgccagtctgctcgatatcgcaggctgggtccgtgactacccactccccctttcaacgtgaaggctacgatagtgccagggcgggtactgccgtaagtgccaccccaaaacaacaacaaccccccctctccctcctccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataat

SEQ ID NO: 3279 - DNA, 248 bp, Bovine picornavirus
  isolate TCH6
ttggatctgagcaggggccccctttgggttgctttacaactcaactgggggttaaaaaacgtctaacccgacacgccagagggatctggtttccttttatttcttttactcaccactggatgcagattgacgataaacgttgttgtttgtgactattgacttgatctgcttctacgggtttactttcactgttatacttcttgctttgtttggtgttcactgtactttgtctccttctacatttcaca

SEQ ID NO: 3280 - DNA, 675 bp, Human poliovirus type 2
  isolate IS_061
ttgtgcgcctgttttatactcccctcccgcaacttagaagcacgaaaccaagttcaatagaagggggtacaaaccagtaccactacgaacaagcacttctgtttccccggtgacattgcatagactgctcacgcggttgaaagtgatcgatccgttacccgcttgtgtacttcgaaaagcctagtatcgccttggaatcttcgacgcgttgcgctcagcacccgaccccggggtgtagcttaggccgatgagtctggacattcctcaccggtgacggtggtccaggctgcgttggcggcctacctatggctaacgccataggacgttagatgtgaacaaggtgtgaagagcctattgagctacataagagtcctccggcccctgaatgcggctaatcctaaccacggagcaggcggtcgcgaaccagtgactggcttgtcgtaacgcgcaagtctgtggcggaaccgactactttgggtgtccgtgtttcctgttatttttatcatggctgcttatggtgacaatcagagattgttatcataaagcgaattggattggccatccggtgagtgttgtgtcaggtatacaactgtttgttggaaccactgtgttagctttgcttctcatttaaccaattaatcaaaaacaatacgaggataaaacaacaatactaca

SEQ ID NO: 3281 - DNA, 675 bp, Human poliovirus type 2
  strain NIE0811460
ttgtgcgcctgttttatattccccccccgcaacttagaagcacgaaaccaagttcaatagaagggggtacaaaccagtaccaccacgaacaagcacttctgtttccccggtgacattgcatagactgctcacgcggttgaaagtgatcgatccgttacccgcttgtgtacttcgaaaagcctagtattgccttggaatcttcgacgcgttgcgctcagcacccgaccccggggtgtagcttaggctgatgagtctggacattcctcaccggtgacggtggtccaggctgcgttggcggcctacctatggctaatgccataggacgctagatgtgaacaaggtgtgaagagcctattgagctacataagagtcctccggcccctgaatgcggctaatcctaaccacggagcaggcggtcgcaaaccagtgactagcttgtcgtaacgcgcaagtctgtggcggaaccgactactttgggtgtccgtgtttcctgttatttttattatggctgcttatggtgacaatcagagattgttatcataaagcgaattggattggccatccggtgagtgttgtgtcaggtatacaactgtttgttggaaccactgtgttagtttaacctctctttcaaccaattagtcaaaaacaatacgaagatagaacaacaatactaca

SEQ ID NO: 3282 - DNA, 601 bp, Canine kobuvirus; identical to SEQ ID NO: 1354

SEQ ID NO: 3283 - DNA, 591 bp, Pigeon picornavirus B
tttatttagctgttaagttttatttgtgccgagaccccatagtaggatcttggtgttccacattaagctctcccgaccacacatccaaacgataggcggtgtaagggctccctggctaagtgtttactcattgctagggaagtgttgcgacccgttaccagtaggaatacaggaggtcttagttgcctaaccagataaagtggtgctgaaatattgcaagctcaatgtctggcgaacgacggactaccgttgaactattgttaacgcccgcgtgtgtaggcaacacacgggttagtaggtcacttacattgacatccgtgccgggaaagcggatctgagctatcgattgcctgatagggtgccggcgggcgcggtacgtgtggtatagtccgctgtcttggggtatggcgtctactcggttttgttgtcgttttggaatgtcccatgtcggagatgtcgttaccggtgtttgctttacttgtgcacgaataagaaaacagagtttggagttttggaagttaatggataacatcaagtttccattgcgttcctcgtgcattttaggccagaaaatcgaccacaaaatcgaga

SEQ ID NO: 3284 - DNA, 619 bp, Bat picornavirus; identical to SEQ ID NO: 715
  isolate BtRs-PicoV

SEQ ID NO: 3285 - DNA, 675 bp, Potamipivirus B
tttcaacgtcgtggctgacgttaaaaagccacaattccacttaccttttaccttttatgtttaatgtttgttagttttgtgatctttaacaaatagatctaaataatttgttggtaaccaatctcggatgtttcggctgcattgtagtttatttatttcattttagttgtaggtggccactacgtcctggaatcatacatggtaacatgtacctcggcggttatccactattacgctaatctaagaatatttaaatgaaaatgtaagtgttacggctgactttgggcctgatagttaaatgctcgcactgacagatagtaccctcctttaggatcgattctgttacatgggatccattttggtgccccactgattcaacctctttgttgaaaaagagttagcatactacaaattttccaaacaaaaaccctttttaatgactacaacttatgattttatgaattttactgctcttgaaaaagatattttgacattgatcgctgtactgtttcagacattcattgcatccatttttgttggctactcctcacaaactcaaaacttttccacacgagaaaccttgtttattgaattttgcctttatattttggaacttgttgttggatttattgtttgcttaattattgacctcacacctgttttaaacactacaat

SEQ ID NO: 3286 - DNA, 729 bp, Kobuvirus sp.
  SZAL6 3?37
tttcacaccctcttttccggtggtccggacccagaccaccgttactccattcagctacttcggtacctgttcggaggaattaaacgggcaccctacccaagggttacatgggaccatattcctcctcccctgtaactttaagttttgtgcccgtattcttgactccaggcggatgttgtgtcgcccgtcctgtgaacaaacagctagacactttcctcccctccctctgggctgctccggcagtccactccctccccccagcgtaacatgccccgctggagtgatgcacctggaagtcgtggacgtgggttagtaacttcggtgaaaacccactataatgacaactggttgacccccacactcaaaggactcgagtctttctcccttaaggctagcccggccacatgaatttgcagctggcaactagtgagtccaccatgtcccgcaacctcggctgcggagtgctgttccccaagcgtatgccttccttctgtaagagtgcgcctggcaagcacatctgagaagtcgttccgctgcgtcgtgccaacctggcgacaggtgacccagtgtgcgtagacttcttccggattcgtccggctcttctctaggaaacatgcgtgtaaggttcatgtgccaaagccctgcgcgcggtgttcttctactgccctaggaatgtgccgcaggtacccctacttcggtagggatctgagcggtagctaattggacatc

SEQ ID NO: 3287 - DNA, 718 bp, Salivirus A; identical to SEQ ID NO: 1367
  02394

SEQ ID NO: 3288 - DNA, 576 bp, Porcine kobuvirus
  K-30
tttgaaaagggggtgggggggcctcggccccctcaccctcttttccggtggccacccgcccgggccaccgttactccactccactccttcgggactggtttggaggaacataacagggcttcccatccctgtttacccttactccactcacccctccccttgaccaaccctatccacaccccactgactgactcctttggatcttgacctcggaatgcctacttgacctcccacttgcctctcccttttcggattgccggtggtgcctggcggaaaaagcacaagtgtgttgttggctaccaaactcctacccgacaaaggtgcgtgtccgcgtgctgagtaatgggataggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 3289 - DNA, 576 bp, Porcine kobuvirus
  GS2
tttgaaaagggggtgggggggcctcggccccctcaccctcttttccggtggccattcgcccgggccaccgttactccactccactccttcgggactggtttggaggaacacaacagggcttcccatccctgtttaccctttattccatcatcctttccccaagtttaccctatccacaccccactgactgactcctttggattttgacctcagaatgcctatttgacctcccactcgcctctcccttttcggattgccggtggtgcctggcggaaaaagcacaagtgtgttgcaggctaccaaactcctacccgacaaaggtgcgtgtccgcgtgctgagtaatgggataggagatgcctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacac

SEQ ID NO: 3290 - DNA, 494 bp, Tremovirus A
tttgaaagaggcctccggagtgtccggaggctctctttcgacccaacccatactggggggtgtgtgggaccgtacctggagtgcacggtatatatgcattcccgcatggcaagggcgtgctaccttgccccttgacgcatggtatgcgtcatcatttgccttggttaagccccatagaaacgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctggctctgacattgggacatttgatgtaaccggacctggttcagtatccgggttgtcctgtattgttacggtgtatccgtcttggcacactgaaagggtatttttgggtaatcctttcctactgcctgatagggtggcgtgcccggccacgagagattaagggtagcaatttaaac

SEQ ID NO: 3291 - DNA, 675 bp, Picornavirales sp.
  isolate RtMruf-PicoV
tttgctcagcgtaacttctccgggttacgtggagaccaaaaggctacggagactcgggctacggccctggagcacctaggtgctcctaaagacgttagaagttgtacaaactcgcccaatagggccccccaaccaggggggtagcgggcaagcacttctgtttccccggtatgatctcataggctgtacccacggctgaaagagagattatcgttacccgcctcactacttcgagaagcccagtaatggttcatgaagttgatctcgttgacccggtgtttcccccacaccagaaacctgtgatgggggtggtcatcccggtcatggcgacatgacggacctccccgcgccggcacagggcctcttcggaggacgagtgacatggattcaaccgtgaagagcctattgagctagtgttgattcctccgcccccgtgaatgcggctaatcccaactccggagcaggcgggcccaaaccagggtctggcctgtcgtaacgcgaaagtctggagcggaaccgactactttcgggaaggcgtgtttccttttgttccttttatcaagttttatggtgacaactcctggtagacgttttattgcgtttattgagagatttccaacaattgaacagactagaaccacttgttttatcaaaccctcacagaataagataaca

SEQ ID NO: 3292 - DNA, 675 bp, Coxsackievirus
  A10
tttgtgcgcctgttttacaacccttccccaacttgtaacgtagaagtaatacacactactgatcaatagcaggcatggcgcgccagtcatgtctcgatcaagcacttctgttcccccggactgagtatcaatagactgctcacgcggttgaaggagaaaacgttcgttacccggctaactacttcgagaaacctagtagcaccatagaagctgcagagtgtttcgctcagcacttcccccgtgtagatcaggctgatgagtcactgcaatccccacgggtgaccgtggcagtggctgcgttggcggcctgcctatggggcaacccataggacgctctaatgtggacatggtgcgaagagtctattgagctagttagtagtcctccggcccctgaatgcggctaatcctaactgcggagcacatgccttcaacccagaaggtagtgtgtcgtaacgggcaactctgcagcggaaccgactactttgggtgtccgtgtttctttttattcctatattggctgcttatggtgacaatcacggaattgttgccatatagctattggattggccatccggtgtctaatagagctattgtgtacctatttgttggatttactccgctatcacataaatctctgaacactttgtgctttatattgaacttaaacacccgaaa

SEQ ID NO: 3293 - DNA, 579 bp, Simian sapelovirus 2
ttttaacttgttatgacattcaaggaaaaaatgtctttttcattatgggactgacctgtttatgaacatgagcagcggcactgctccacgggctatccgtgtaagaaatattgattattcttatggatcatgatttcagggttggccgcccagtctaaaaggcaattgtggtaagctatgtaagtagttggctgttgaaaggagccaagtacatcctaggtctacgctgtgcgggccgaagtaagacttggaacaactctgagtaggcagtttttctctttagcccaacacgaccgcatactgaagagctagaggcactttggggcaaaggtaaaagcattgcttagaccgaatgttcaatgagaccttgacgagtgctgtcacagtgtcccctgatggcagtatggcgcatgctcttggcattacccatatgtgtatctatagggggggggccccctatacttagtctagtgctacctgacagggccgcggctggtcgtcggtgtgtggtataaccagtagtaatcccccatggattgctttaactccccctcctccctcaacaaaactttctctaag

SEQ ID NO: 3294 - DNA, 675 bp, Saffold virus
  V13C
ttttcgacgtggttggaattgccatcatttccgacgaaagtgctatcatgcctccccgattatgtgatgttttctgccctgctgggcggagcattctcgggttgagaaaccttgaatctttttctttggaaccttggttcccccggtctaagccgcttggaatatgacagggttattttcttgatcttatttctacttttgcgggttctatccgtaaaaagggtacgtgctgccccttccttctctggagaattcacacggcggtctttccgtctctcaacaagtgtgaatgcagcatgccggaaacggtgaagaaaacagttttctgtggaaatttagagtgcacatcgaaacagctgtagcgacctcacagtagcagcggactcccctcttggcgacaagagcctctgcggccaaaagccccgtggataagatccactgctgtgagcggtgcaaccccagcaccctggttcgatgatcattctctatggaaccagaaaatggttttctcaagccctccggtagagaagccaagaatgtcctgaaggtaccccgcgtgcgggatctgatcaggagaccaattggcggtgctttacactgtcactttggtttaaaaattgtcacagcttctccaaaccaagtggtcttggttttccaattttgttgaatggcaat

SEQ ID NO: 3295 - DNA, 512 bp, Unknown
  Description of Unknown: Boosepivirus B sequence
ttttctcccctccccctccaactaccttttccccctcttgtaacgctagaagtttgtgcaaaccgcctgtagggtactgcaatccagcagtgcataggctaagcttttcttgttaccccaccccacattatactgaggaggattgtgaaattgtgttagtatgggttagtagcggtgacccgggtaaccccaacccagaaactcacggatgagatgaacaggaccccacatggtaacgtgtgtgttcgtctgccccgcaaggtgaggccgtgagagctttgcacgcgaaaaccttgaaaacccaaaagtaccttgagctcttcgctattttgtgtttcctccaggaccctgaatgcggctaaacctaacccgcgatccgcacgtagcaacccagctagagtgtggtcgtaatgcgcaagttgcgggcggtaccgactactttggtgttcctgtgtttcctttattttattttgaatttttatggtgacaacagctagaaaataagagtgaac

SEQ ID NO: 3296 - DNA, 512 bp, Bovine picornavirus; identical to SEQ ID NO: 3295

SEQ ID NO: 3297 - DNA, 537 bp, Bovine rhinitis A virus
ttttgcggctctgccgccgttcgggttttacctgttttcacagagcaaaacaggacctctagtttcgtgcttaaacgagatcatgctcgaactagaactataacgctggtcactggacccgtgccgcgccttgcggatctttgcgggaatggtggctagtgggctgtggaagtgactctaaccacacgcccctcaagtgtgggaaaacacgaactggtgtagcgacgacgataggccttgggacaccctctccagtgatggagacccaaggggccaaaagccacgccttgtgccctgtcgttcacaaccccagtgcagttcgtgccagtacctgcttttgggaagtgtgctttggacagctgaaaacagtcctagtgggagactaaggatgcccaggaggtacccggaggtaacaagtgacactctggatctgacttggggagagcgggtctgctttacagacgccactctttaaaaaacttctatgtctcgtcaggcaccggaggccgggccttttcctttaaaacaatacacttt

SEQ ID NO: 3298 - DNA, 593 bp, Rhinolophus picornavirus
  strain Guizhou-Rr100
ttttttttctcaggcggtagcatccagccaaggcctgatgctaccaacgtgtgactaaaccacactctctttttgtgatacattgtgtcacctatccctttcttggtaacttagaagcttgtacacccacgcacgtaggtaccccacatccagtggggtttgtgcaaagcattcttgttccccggtaaaccctgataggctgtaaccacggctgaaacaaggtttgtcgttacccgactcactactacgcaaagcctagtaaagttcaatgaaagtgcgcagcgtgatccggtcaaaacccccttgaccagaaacacatgatgagggtcaccaacccccactggcgacagtgtggtgtccctgcgttggcatgtggcctcatagaggcgttgcaatctggatttgctccgaagagccccgtgtgctagtgtttatacctccggccccttgaatgcggctaatcctaacccccgagcatgtacacacacgccagtgtgcagcatgtcgtaatgagcaatttggggatggaaccgactactttagggtgtccgtgtttctcattattctttgtttgatgttttatggtgacaaca

SEQ ID NO: 3299 - DNA, 240 bp, Artificial Sequence
  Description of Artificial Sequence: Synthetic polynucleotide
gaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3300 - DNA, 239 bp, Artificial Sequence
  Description of Artificial Sequence: Synthetic polynucleotide
aagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3301 - DNA, 238 bp, Artificial Sequence
  Description of Artificial Sequence: Synthetic polynucleotide
agaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3302 - DNA, 190 bp, Artificial Sequence
  Description of Artificial Sequence: Synthetic polynucleotide
gttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3303 - DNA, 189 bp, Artificial Sequence
  Description of Artificial Sequence: Synthetic polynucleotide
ttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3304 - DNA, 188 bp, Artificial Sequence
  Description of Artificial Sequence: Synthetic polynucleotide
tatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3305 - DNA, 187 bp, Artificial Sequence
  Description of Artificial Sequence: Synthetic polynucleotide
atagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3306 - DNA, 186 bp, Artificial Sequence
  Description of Artificial Sequence: Synthetic polynucleotide
tagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3307 - DNA, 139 bp, Artificial Sequence
  Description of Artificial Sequence: Synthetic polynucleotide
acaatagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3308 - DNA, 138 bp, Artificial Sequence
  Description of Artificial Sequence: Synthetic polynucleotide
caatagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3309 - DNA, 137 bp, Artificial Sequence
  Description of Artificial Sequence: Synthetic polynucleotide
aatagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3310 - DNA, 136 bp, Artificial Sequence
  Description of Artificial Sequence: Synthetic polynucleotide
atagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3311 - DNA, 135 bp, Artificial Sequence
  Description of Artificial Sequence: Synthetic polynucleotide
tagatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3312 - DNA, 134 bp, Artificial Sequence
  Description of Artificial Sequence: Synthetic polynucleotide
agatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3313 - DNA, 133 bp, Artificial Sequence
  Description of Artificial Sequence: Synthetic polynucleotide
gatgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3314 - DNA, 132 bp, Artificial Sequence
  Description of Artificial Sequence: Synthetic polynucleotide
atgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3315 - DNA, 131 bp, Artificial Sequence
  Description of Artificial Sequence: Synthetic polynucleotide
tgacttacaactaatcggaaggtgcagagactcgacgggagctaccctaacgtcaagacgagggtaaagagagagtccaattctcaaagccaataggcagtagcgaaagctgcaagagaatgaaaatccgt

SEQ ID NO: 3316 - DNA, 78 bp, Artificial Sequence
  Description of Artificial Sequence: Synthetic polynucleotide
caagacgagggtaaagagagagtccaattctcaaagccaataggcagtagcgaaagctgcaagagaatgaaaatccgt

SEQ ID NO: 3317 - DNA, 77 bp, Artificial Sequence
  Description of Artificial Sequence: Synthetic polynucleotide
aagacgagggtaaagagagagtccaattctcaaagccaataggcagtagcgaaagctgcaagagaatgaaaatccgt

SEQ ID NO: 3318 - DNA, 76 bp, Artificial Sequence
  Description of Artificial Sequence: Synthetic polynucleotide
agacgagggtaaagagagagtccaattctcaaagccaataggcagtagcgaaagctgcaagagaatgaaaatccgt

SEQ ID NO: 3319 - DNA, 75 bp, Artificial Sequence
  Description of Artificial Sequence: Synthetic polynucleotide
gacgagggtaaagagagagtccaattctcaaagccaataggcagtagcgaaagctgcaagagaatgaaaatccgt

SEQ ID NO: 3320 - DNA, 74 bp, Artificial Sequence
  Description of Artificial Sequence: Synthetic polynucleotide
acgagggtaaagagagagtccaattctcaaagccaataggcagtagcgaaagctgcaagagaatgaaaatccgt

SEQ ID NO: 3321 - DNA, 40 bp, Artificial Sequence
  Description of Artificial Sequence: Synthetic polynucleotide
aataggcagtagcgaaagctgcaagagaatgaaaatccgt

SEQ ID NO: 3322 - DNA, 39 bp, Artificial Sequence
  Description of Artificial Sequence: Synthetic polynucleotide
ataggcagtagcgaaagctgcaagagaatgaaaatccgt

SEQ ID NO: 3323 - DNA, 38 bp, Artificial Sequence
  Description of Artificial Sequence: Synthetic polynucleotide
taggcagtagcgaaagctgcaagagaatgaaaatccgt

SEQ ID NO: 3324 - DNA, 37 bp, Artificial Sequence
  Description of Artificial Sequence: Synthetic polynucleotide
aggcagtagcgaaagctgcaagagaatgaaaatccgt

SEQ ID NO: 3325 - DNA, 36 bp, Artificial Sequence
  Description of Artificial Sequence: Synthetic polynucleotide
ggcagtagcgaaagctgcaagagaatgaaaatccgt

SEQ ID NO: 3326 - DNA, 27 bp, Artificial Sequence
  Description of Artificial Sequence: Synthetic polynucleotide
gaaagctgcaagagaatgaaaatccgt

SEQ ID NO: 3327 - DNA, 26 bp, Artificial Sequence
  Description of Artificial Sequence: Synthetic polynucleotide
aaagctgcaagagaatgaaaatccgt

SEQ ID NO: 3328 - DNA, 25 bp, Artificial Sequence
  Description of Artificial Sequence: Synthetic polynucleotide
aagctgcaagagaatgaaaatccgt

SEQ ID NO: 3329 - DNA, 24 bp, Artificial Sequence
  Description of Artificial Sequence: Synthetic polynucleotide
agctgcaagagaatgaaaatccgt

SEQ ID NO: 3330 - DNA, 23 bp, Artificial Sequence
  Description of Artificial Sequence: Synthetic polynucleotide
gctgcaagagaatgaaaatccgt

SEQ ID NO: 3331 - DNA, 22 bp, Artificial Sequence
  Description of Artificial Sequence: Synthetic polynucleotide
ctgcaagagaatgaaaatccgt

SEQ ID NO: 3332 - DNA, 18 bp, Artificial Sequence
  Description of Artificial Sequence: Synthetic polynucleotide
aagagaatgaaaatccgt

SEQ ID NO: 3333 - DNA, 17 bp, Artificial Sequence
  Description of Artificial Sequence: Synthetic polynucleotide
agagaatgaaaatccgt

SEQ ID NO: 3334 - DNA, 16 bp, Artificial Sequence
  Description of Artificial Sequence: Synthetic polynucleotide
gagaatgaaaatccgt

SEQ ID NO: 3335 - DNA, 35 bp, Artificial Sequence
  Description of Artificial Sequence: Synthetic polynucleotide
gcagtagcgaaagctgcaagagaatgaaaatccgt

SEQ ID NO: 3336 - DNA, 33 bp, Artificial Sequence
  Description of Artificial Sequence: Synthetic polynucleotide
agtagcgaaagctgcaagagaatgaaaatccgt

SEQ ID NO: 3337 - DNA, 32 bp, Artificial Sequence
  Description of Artificial Sequence: Synthetic polynucleotide
gtagcgaaagctgcaagagaatgaaaatccgt

SEQ ID NO: 3338 - DNA, 26 bp, Artificial Sequence
  Description of Artificial Sequence: Synthetic polynucleotide
acggacttaaataattgagccttaaa

SEQ ID NO: 3339 - DNA, 27 bp, Artificial Sequence
  Description of Artificial Sequence: Synthetic polynucleotide
acggacttaaataattgagccttaaag

SEQ ID NO: 3340 - DNA, 28 bp, Artificial Sequence
  Description of Artificial Sequence: Synthetic polynucleotide
acggacttaaataattgagccttaaaga

SEQ ID NO: 3341 - DNA, 76 bp, Artificial Sequence
  Description of Artificial Sequence: Synthetic polynucleotide
acggacttaaataattgagccttaaagaagaaattctttaagtggatgctctcaaactcagggaaacctaaatcta

SEQ ID NO: 3342 - DNA, 77 bp, Artificial Sequence
  Description of Artificial Sequence: Synthetic polynucleotide
acggacttaaataattgagccttaaagaagaaattctttaagtggatgctctcaaactcagggaaacctaaatctag

SEQ ID NO: 3343 - DNA, 78 bp, Artificial Sequence
  Description of Artificial Sequence: Synthetic polynucleotide
acggacttaaataattgagccttaaagaagaaattctttaagtggatgctctcaaactcagggaaacctaaatctagt

SEQ ID NO: 3344 - DNA, 79 bp, Artificial Sequence
  Description of Artificial Sequence: Synthetic polynucleotide
acggacttaaataattgagccttaaagaagaaattctttaagtggatgctctcaaactcagggaaacctaaatctagtt

SEQ ID NO: 3345 - DNA, 80 bp, Artificial Sequence
  Description of Artificial Sequence: Synthetic polynucleotide
acggacttaaataattgagccttaaagaagaaattctttaagtggatgctctcaaactcagggaaacctaaatctagtta

SEQ ID NO: 3346 - DNA, 127 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagtta

SEQ ID NO: 3347 - DNA, 128 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaa

SEQ ID NO: 3348 - DNA, 129 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaac

SEQ ID NO: 3349 - DNA, 130 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaaca

SEQ ID NO: 3350 - DNA, 131 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaa

SEQ ID NO: 3351 - DNA, 132 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaat

SEQ ID NO: 3352 - DNA, 133 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaata

SEQ ID NO: 3353 - DNA, 134 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatag

SEQ ID NO: 3354 - DNA, 135 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaataga

SEQ ID NO: 3355 - DNA, 188 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgt

SEQ ID NO: 3356 - DNA, 189 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtc

SEQ ID NO: 3357 - DNA, 190 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtca

SEQ ID NO: 3358 - DNA, 191 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaa

SEQ ID NO: 3359 - DNA, 192 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaag

SEQ ID NO: 3360 - DNA, 226 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagcc

SEQ ID NO: 3361 - DNA, 227 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagcca

SEQ ID NO: 3362 - DNA, 228 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaa

SEQ ID NO: 3363 - DNA, 229 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaat

SEQ ID NO: 3364 - DNA, 230 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaata

SEQ ID NO: 3365 - DNA, 239 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagc

SEQ ID NO: 3366 - DNA, 240 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcg

SEQ ID NO: 3367 - DNA, 241 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcga

SEQ ID NO: 3368 - DNA, 242 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaa

SEQ ID NO: 3369 - DNA, 243 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaa

SEQ ID NO: 3370 - DNA, 244 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaag

SEQ ID NO: 3371 - DNA, 248 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaagctgc

SEQ ID NO: 3372 - DNA, 249 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaagctgca

SEQ ID NO: 3373 - DNA, 250 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggcagtagcgaaagctgcaa

SEQ ID NO: 3374 - DNA, 231 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaatag

SEQ ID NO: 3375 - DNA, 233 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggc

SEQ ID NO: 3376 - DNA, 234 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataggca

SEQ ID NO: 3377 - DNA, 104 bp, Azoarcus olearius
tgcgccgatgaaggtgtagagactagacggcacccacctaaggcaaacgctatggtgaaggcatagtccagggagtggcgaaagtcacacaaaccggaatccgt

SEQ ID NO: 3378 - DNA, 141 bp, Azoarcus olearius
ccgggcgtatggcaacgccgagccaagcttcggcgcctgcgccgatgaaggtgtagagactagacggcacccacctaaggcaaacgctatggtgaaggcatagtccagggagtggcgaaagtcacacaaaccggaatccgt

SEQ ID NO: 3379 - DNA, 78 bp, Azoarcus olearius
acggcacccacctaaggcaaacgctatggtgaaggcatagtccagggagtggcgaaagtcacacaaaccggaatccgt

SEQ ID NO: 3380 - DNA, 58 bp, Azoarcus olearius
acgctatggtgaaggcatagtccagggagtggcgaaagtcacacaaaccggaatccgt

SEQ ID NO: 3381 - DNA, 75 bp, Thiomargarita namibiensis
attaaagttatagaattatcagagaatgatatagtccaagccttatggtaacatgagggcacttgaccctggtag

SEQ ID NO: 3382 - DNA, 195 bp, Unknown
  Description of Unknown: Staphylococcus phage Twort sequence
aagatgtaggcaatcctgagctaagctcttagtaataagagaaagtgcaacgactattccgataggaagtagggtcaagtgactcgaaatggggattacccttctagggtagtgatatagtctgaacatatatggaaacatatagaaggataggagtaacgaacctattcgtaacataattgaacttttagttat

SEQ ID NO: 3383 - DNA, 163 bp, Unknown
  Description of Unknown: Staphylococcus phage Twort sequence
taataagagaaagtgcaacgactattccgataggaagtagggtcaagtgactcgaaatggggattacccttctagggtagtgatatagtctgaacatatatggaaacatatagaaggataggagtaacgaacctattcgtaacataattgaacttttagttat

SEQ ID NO: 3384 - DNA, 133 bp, Unknown
  Description of Unknown: Staphylococcus phage Twort sequence
taggaagtagggtcaagtgactcgaaatggggattacccttctagggtagtgatatagtctgaacatatatggaaacatatagaaggataggagtaacgaacctattcgtaacataattgaacttttagttat

SEQ ID NO: 3385 - DNA, 92 bp, Unknown
  Description of Unknown: Staphylococcus phage Twort sequence
ctagggtagtgatatagtctgaacatatatggaaacatatagaaggataggagtaacgaacctattcgtaacataattgaacttttagttat

SEQ ID NO: 3386 - DNA, 92 bp, Aspergillus pseudoglaucus
agttaataaagatgatgaaatagtctgaaccattttgagaaaagtggaaataaaagaaaatcttttatgataacataaattgaacaggctaa

SEQ ID NO: 3387 - DNA, 62 bp, Unknown
  Description of Unknown: Bacteriophage Phi I sequence
caaagactgatgatatagtccgacactcctagtaataggagaatacagaaaggatgaaatcc

SEQ ID NO: 3388 - DNA, 76 bp, Nostoc sp.
  PCC 7524
agtcgagggtaaagggagagtccaattctcaaagcctattggcagtagcgaaagctgcgggagaatgaaaatccgt

SEQ ID NO: 3389 - DNA, 76 bp, Nostoc sp.
  CENA543
agccgagggtaaagggagagtccaattctcaaagccaataggcagtagcgaaagctgcgggagaatgaaaatccgt

SEQ ID NO: 3390 - DNA, 89 bp, Nodularia spumigena
agccgagggtaaagggagagtccaattctcaaagccgaaggttattaaaacctggcagcagtgaaagctgcgggagaatgaaaatccgt

SEQ ID NO: 3391 - DNA, 79 bp, Pleurocapsa sp.
  PCC 7327
agctgagggtaaagagagagtccaattctcaaagccagcagatggcagtagcgaaagctgcgggagaatgaaaatccgt

SEQ ID NO: 3392 - DNA, 76 bp, Planktothrix agardhii
agccgagggtaaagagagagtccaattctcaaagccaattggtagtagcgaaagctacgggagaatgaaaatccgt

SEQ ID NO: 3393 - DNA, 118 bp, Azoarcus olearius
gcggactcatatttcgatgtgccttgcgccgggaaaccacgcaagggatggtgtcaaattcggcgaaacctaagcgcccgcccgggcgtatggcaacgccgagccaagcttcggcgcc

SEQ ID NO: 3394 - DNA, 81 bp, Azoarcus olearius
gcggactcatatttcgatgtgccttgcgccgggaaaccacgcaagggatggtgtcaaattcggcgaaacctaagcgcccgc

SEQ ID NO: 3395 - DNA, 144 bp, Azoarcus olearius
gcggactcatatttcgatgtgccttgcgccgggaaaccacgcaagggatggtgtcaaattcggcgaaacctaagcgcccgcccgggcgtatggcaacgccgagccaagcttcggcgcctgcgccgatgaaggtgtagagactag

SEQ ID NO: 3396 - DNA, 164 bp, Azoarcus olearius
gcggactcatatttcgatgtgccttgcgccgggaaaccacgcaagggatggtgtcaaattcggcgaaacctaagcgcccgcccgggcgtatggcaacgccgagccaagcttcggcgcctgcgccgatgaaggtgtagagactagacggcacccacctaaggcaa

SEQ ID NO: 3397 - DNA, 179 bp, Thiomargarita namibiensis
aggattagatactacactaagtgtcccccagactggtgacagtctggtgtgcatccagctatatcggtgaaaccccattggggtaataccgagggaagctatattatatatatattaataaatagccccgtagagactatgtaggtaaggagatagaagatgataaaatcaaaatcatc

SEQ ID NO: 3398 - DNA, 84 bp, Unknown
  Description of Unknown: Staphylococcus phage Twort sequence
actactgaaagcataaataattgtgcctttatacagtaatgtatatcgaaaaatcctctaattcagggaacacctaaacaaact

SEQ ID NO: 3399 - DNA, 116 bp, Unknown
  Description of Unknown: Staphylococcus phage Twort sequence
actactgaaagcataaataattgtgcctttatacagtaatgtatatcgaaaaatcctctaattcagggaacacctaaacaaactaagatgtaggcaatcctgagctaagctcttag

SEQ ID NO: 3400 - DNA, 146 bp, Unknown
  Description of Unknown: Staphylococcus phage Twort sequence
actactgaaagcataaataattgtgcctttatacagtaatgtatatcgaaaaatcctctaattcagggaacacctaaacaaactaagatgtaggcaatcctgagctaagctcttagtaataagagaaagtgcaacgactattccga

SEQ ID NO: 3401 - DNA, 187 bp, Unknown
  Description of Unknown: Staphylococcus phage Twort sequence
actactgaaagcataaataattgtgcctttatacagtaatgtatatcgaaaaatcctctaattcagggaacacctaaacaaactaagatgtaggcaatcctgagctaagctcttagtaataagagaaagtgcaacgactattccgataggaagtagggtcaagtgactcgaaatggggattaccctt

SEQ ID NO: 3402 - DNA, 216 bp, Aspergillus pseudoglaucus
cgctagggatttataactgtgagtcctccaatattataaaatgttggtaatatattgggtaaatttcaaagacaacttttctccacgtcaggatatagtgtatttgaagcgaaacttattttagcagtgaaaaagcaaataaggacgttcaacgactaaaaggtgagtattgctaacaataatccttttttttaatgcccaacatctttattaact

SEQ ID NO: 3403 - DNA, 559 bp, Unknown
  Description of Unknown: Bacteriophage Phi I sequence
gtgggtgcataaactatttcattgtgcacattaaatctggtgaactcggtgaaaccctaatggggcaataccgagccaagccatagggaggatatatgagaggcaagaagttaattcttgaggccactgagactggctgtatcatccctacgtcacacaaacttaatgccgatggttatttcagaaagaaaaccaatggcgtcttagagatgtatcacagaacggtgtggaaggagcataacggagacatacctgatggcttcgagatagaccataagtgtcgcaatagggcttgctgtaatatagagcatttacagatgcttgagggtacagcccacactgttaagaccaatcgtgaacgctacgcagacagaaaggaaacagctagggaatactggctggagactggatgtaccggcctagcactcggtgagaagtttggtgtgtcgttctcttctgcttgtaagtggattagagaatggaaggcgtagagactatccgaaaggagtagggccgagggtgagactccctcgtaacccgaagcgccagacagtcaact

SEQ ID NO: 3404 - DNA, 218 bp, Nostoc sp.
  PCC 7524
acggacttaagtaattgagccttaaagaagaaattctttaagtggcagctctcaaactcagggaaacctaaatctgttcacagacaaggcaatcctgagccaagccgaaagagtcatgagtgctgagtagtgagtaaaataaaagctcacaactcagaggttgtaactctaagctagtcggaaggtgcagagactcgacgggagctaccctaacgtaa

SEQ ID NO: 3405 - DNA, 165 bp, Nostoc sp.
  CENA543
acggacttaaactgaattgagccttagagaagaaattctttaagtgtcagctctcaaactcagggaaacctaaatctgttgacagacaaggcaatcctgagccaagccgagaactctaagttattcggaaggtgcagagactcgacgggagctaccctaacgtca

SEQ ID NO: 3406 - DNA, 181 bp, Nodularia spumigena
acggacttagaaaactgagccttgatcgagaaatctttcaagtggaagctctcaaattcagggaaacctaaatctgtttacagatatggcaatcctgagccaagccgaaacaagtcctgagtgttaaagctcataactcatcggaaggtgcagagactcgacgggagctaccctaacgtta

SEQ ID NO: 3407 - DNA, 188 bp, Pleurocapsa sp.
  PCC 7327
acggacttaaaaaaattgagccttggcagagaaatctgtcatgcgaacgctctcaaattcagggaaacctaagtctggcaacagatatggcaatcctgagccaagccttaatcaaggaaaaaaacatttttaccttttaccttgaaaggaaggtgcagagactcaacgggagctaccctaacaggtca

SEQ ID NO: 3408 - DNA, 200 bp, Planktothrix agardhii
acggacttaaagataaattgagccttgaggcgagaaatctctcaagtgtaagctgtcaaattcagggaaacctaaatctgtaaattcagacaaggcaatcctgagccaagcctaggggtattagaaatgagggagtttccccaatctaagatcaatacctaggaaggtgcagagactcgacgggagctaccctaacgtta

SEQ ID NO: 3409 - DNA, 162 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaacacaaacacaacttatatact

SEQ ID NO: 3410 - DNA, 172 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaacacaaacacaagagtataagtataatttcag

SEQ ID NO: 3411 - DNA, 182 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaacacaaacacaagtcatatactgagtataagtataatttcag

SEQ ID NO: 3412 - DNA, 192 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaacacaaacacaagtcatatactgagtataagtataatttcatattgttgatg

SEQ ID NO: 3413 - DNA, 202 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaacacaaacacaagcgataatgcttcatatactgagtataagtatagtttcatattgttgatg

SEQ ID NO: 3414 - DNA, 162 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaaaacaaaaacaagctgacgcta

SEQ ID NO: 3415 - DNA, 172 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaaaacaaaaacaagctgacgctagtatgagtat

SEQ ID NO: 3416 - DNA, 182 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaaaacaaaaacaagctgacgctagtatgagtatagcttcacac

SEQ ID NO: 3417 - DNA, 192 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaaaacaaaaacaagctgacgctagtatgagtatagcttcacactcaggtgagg

SEQ ID NO: 3418 - DNA, 202 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaaaacaaaaacaagctgacgctagtatgagtatagcttcacactcaggtgaggcatcattcgg

SEQ ID NO: 3419 - DNA, 162 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaaaacaaaaacaagctcgcaccg

SEQ ID NO: 3420 - DNA, 172 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaaaacaaaaacaagctcgcactgggtcggagcg

SEQ ID NO: 3421 - DNA, 182 bp, Artificial Sequence; identical to SEQ ID NO: 3411
  Description of Artificial Sequence: Synthetic polynucleotide

SEQ ID NO: 3422 - DNA, 182 bp, Artificial Sequence; identical to SEQ ID NO: 3411
  Description of Artificial Sequence: Synthetic polynucleotide

SEQ ID NO: 3423 - DNA, 182 bp, Artificial Sequence; identical to SEQ ID NO: 3411
  Description of Artificial Sequence: Synthetic polynucleotide

SEQ ID NO: 3424 - DNA, 182 bp, Artificial Sequence; identical to SEQ ID NO: 3411
  Description of Artificial Sequence: Synthetic polynucleotide

SEQ ID NO: 3425 - DNA, 182 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaacacaaacacaagtaacttagagagtataagtataatttcag

SEQ ID NO: 3426 - DNA, 182 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaacacaaacacaagtaacttagatgtaacacacataatttcag

SEQ ID NO: 3427 - DNA, 182 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaacacaaacacaagtaacttagatgtaacacacaccgatcaac

SEQ ID NO: 3428 - DNA, 182 bp, Artificial Sequence
  Description of Artificial Sequence: Synthetic polynucleotide
ctgtttaatcacggacttaaataattgagccttaaagaagaaattctttaagtggatgctctcaaactcagggaaacctaaatctagttatagacaaggcaatcctgagccaagccgaagtagtaattagtaagttaacaacacaaacacaagtcatatactgagtataagtataatttcag

SEQ ID NO: 3429 - DNA, 192 bp, Artificial Sequence
  Description of Artificial Sequence: Synthetic polynucleotide
cgtaatttatattgtgaatcacggacttaaataattgagccttaaagaagaaattctttaagtggatgctctcaaactcagggaaacctaaatctagttatagacaaggcaatcctgagccaagccgaagtagtaattagtaagttaacaacacaaacacaagtcatatactgagtataagtataatttcag

SEQ ID NO: 3430 - DNA, 182 bp, Artificial Sequence
  Description of Artificial Sequence: Synthetic polynucleotide
gctatgatccacggacttaaataattgagccttaaagaagaaattctttaagtggatgctctcaaactcagggaaacctaaatctagttatagacaaggcaatcctgagccaagccgaagtagtaattagtaagttaacaacacaaacacaagtcatatactgagtataagtataatttcag

SEQ ID NO: 3431 - DNA, 192 bp, Artificial Sequence
  Description of Artificial Sequence: Synthetic polynucleotide
cggatattatgctgcgatccacggacttaaataattgagccttaaagaagaaattctttaagtggatgctctcaaactcagggaaacctaaatctagttatagacaaggcaatcctgagccaagccgaagtagtaattagtaagttaacaacacaaacacaagtcatatactgagtataagtataatttcag

SEQ ID NO: 3432 - DNA, 192 bp, Artificial Sequence
  Description of Artificial Sequence: Synthetic polynucleotide
cggtaggcgcgctgcgagccacggacttaaataattgagccttaaagaagaaattctttaagtggatgctctcaaactcagggaaacctaaatctagttatagacaaggcaatcctgagccaagccgaagtagtaattagtaagttaacaacacaaacacaagtcatatactgagtataagtataatttcag

SEQ ID NO: 3433 - DNA, 215 bp, Artificial Sequence
  Description of Artificial Sequence: Synthetic polynucleotide
gcgctaacgtcgacgccggcaaacggtaggcgcgctgcgagccacggacttaaataattgagccttaaagaagaaattctttaagtggatgctctcaaactcagggaaacctaaatctagttatagacaaggcaatcctgagccaagccgaagtagtaattagtaagttaacaacacaaacacaagtcatatactgagtataagtataatttcag

SEQ ID NO: 3434 - DNA, 215 bp, Artificial Sequence
  Description of Artificial Sequence: Synthetic polynucleotide
gcatgtcacttgtatcctcgaaacggatattatgctgcgatccacggacttaaataattgagccttaaagaagaaattctttaagtggatgctctcaaactcagggaaacctaaatctagttatagacaaggcaatcctgagccaagccgaagtagtaattagtaagttaacaacacaaacacaagtcatatactgagtataagtataatttcag

SEQ ID NO: 3435 - DNA, 215 bp, Artificial Sequence
  Description of Artificial Sequence: Synthetic polynucleotide
gttagagttatcatttatcgaaacgtaatttagattgtgaatcacggacttaaataattgagccttaaagaagaaattctttaagtggatgctctcaaactcagggaaacctaaatctagttatagacaaggcaatcctgagccaagccgaagtagtaattagtaagttaacaacacaaacacaagtcatatactgagtataagtataatttcag

SEQ ID NO: 3436 - DNA, 152 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaacacaaacacaa

SEQ ID NO: 3437 - DNA, 157 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaaaacaaaaacaagcccg

SEQ ID NO: 3438 - DNA, 182 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaaaacaaaaacaagctcgcactggccggaagctcgtcggagcg

SEQ ID NO: 3439 - DNA, 251 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaatacacaaacacaa

SEQ ID NO: 3440 - DNA, 261 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaatacacaaacacaacttatatact

SEQ ID NO: 3441 - DNA, 271 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaatacacaaacacaagagtataagtataatttcag

SEQ ID NO: 3442 - DNA, 281 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaatacacaaacacaagtcatatactgagtataagtataatttcag

SEQ ID NO: 3443 - DNA, 261 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataaacaaaaacaagctgacgcta

SEQ ID NO: 3444 - DNA, 271 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataaacaaaaacaagctgacgctagtatgagtat

SEQ ID NO: 3445 - DNA, 281 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataaacaaaaacaagctgacgctagtatgagtatagcttcacac

SEQ ID NO: 3446 - DNA, 261 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataaacaaaaacaagctcgcaccg

SEQ ID NO: 3447 - DNA, 271 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataaacaaaaacaagctcgcactgggtcggagcg

SEQ ID NO: 3448 - DNA, 281 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaataaacaaaaacaagctcgcactggccggaagctcgtcggagcg

SEQ ID NO: 3449 - DNA, 210 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtccacaaacacaa

SEQ ID NO: 3450 - DNA, 220 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtccacaaacacaacttatatact

SEQ ID NO: 3451 - DNA, 230 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtccacaaacacaagagtataagtataatttcag

SEQ ID NO: 3452 - DNA, 240 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtccacaaacacaagtcatatactgagtataagtataatttcag

SEQ ID NO: 3453 - DNA, 220 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaacaaaaacaagctgacgcta

SEQ ID NO: 3454 - DNA, 230 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaacaaaaacaagctgacgctagtatgagtat

SEQ ID NO: 3455 - DNA, 240 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaacaaaaacaagctgacgctagtatgagtatagcttcacac

SEQ ID NO: 3456 - DNA, 220 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaacaaaaacaagctcgcaccg

SEQ ID NO: 3457 - DNA, 230 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaacaaaaacaagctcgcactgggtcggagcg

SEQ ID NO: 3458 - DNA, 240 bp, Artificial Sequence
  Description of Artificial Sequence: Synthetic polynucleotide
gctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaacaaaaacaagctcgcactggccggaagctcgtcggagcg

SEQ ID NO: 3459 - DNA, 172 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaacacaaacacaagtcatatactgagtataagtataatttcag

SEQ ID NO: 3460 - DNA, 271 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaatacacaaacacaagtcatatactgagtataagtataatttcag

SEQ ID NO: 3461 - DNA, 281 bp, Artificial Sequence
  Description of Artificial Sequence: Synthetic polynucleotide
ctgtttaatcacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaatacacaaacacaagtcatatactgagtataagtataatttcag

SEQ ID NO: 3462 - DNA, 291 bp, Artificial Sequence
  Description of Artificial Sequence: Synthetic polynucleotide
cgtaatttatattgtgaatcacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaatacacaaacacaagtcatatactgagtataagtataatttcag

SEQ ID NO: 3463 - DNA, 281 bp, Artificial Sequence
  Description of Artificial Sequence: Synthetic polynucleotide
gctatgatccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaatacacaaacacaagtcatatactgagtataagtataatttcag

SEQ ID NO: 3464 - DNA, 291 bp, Artificial Sequence
  Description of Artificial Sequence: Synthetic polynucleotide
cggatattatgctgcgatccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaatacacaaacacaagtcatatactgagtataagtataatttcag

SEQ ID NO: 3465 - DNA, 291 bp, Artificial Sequence
  Description of Artificial Sequence: Synthetic polynucleotide
cggtaggcgcgctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtcaagacgagggtaaagagagagtccaattctcaaagccaatacacaaacacaagtcatatactgagtataagtataatttcag

SEQ ID NO: 3466 - DNA, 230 bp, Artificial Sequence
  Description of Artificial Sequence: Synthetic polynucleotide
acggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtccacaaacacaagtcatatactgagtataagtataatttcag

SEQ ID NO: 3467 - DNA, 240 bp, Artificial Sequence
  Description of Artificial Sequence: Synthetic polynucleotide
ctgtttaatcacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtccacaaacacaagtcatatactgagtataagtataatttcag

SEQ ID NO: 3468 - DNA, 250 bp, Artificial Sequence
  Description of Artificial Sequence: Synthetic polynucleotide
cgtaatttatattgtgaatcacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtccacaaacacaagtcatatactgagtataagtataatttcag

SEQ ID NO: 3469 - DNA, 240 bp, Artificial Sequence
  Description of Artificial Sequence: Synthetic polynucleotide
gctatgatccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtccacaaacacaagtcatatactgagtataagtataatttcag

SEQ ID NO: 3470 - DNA, 250 bp, Artificial Sequence
  Description of Artificial Sequence: Synthetic polynucleotide
cggatattatgctgcgatccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtccacaaacacaagtcatatactgagtataagtataatttcag

SEQ ID NO: 3471 - DNA, 250 bp, Artificial Sequence
  Description of Artificial Sequence: Synthetic polynucleotide
cggtaggcgcgctgcgagccacggacttaaataattgagccttaaagaagaaattctttaagtggatgctctcaaactcagggaaacctaaatctagttatagacaaggcaatcctgagccaagccgaagtagtaattagtaagttaacaatagatgacttacaactaatcggaaggtgcagagactcgacgggagctaccctaacgtccacaaacacaagtcatatactgagtataagtataatttcag

SEQ ID NO: 3472 - DNA, 162 bp, Artificial Sequence; identical to SEQ ID NO: 3409
  Description of Artificial Sequence: Synthetic polynucleotide

SEQ ID NO: 3473 - DNA, 172 bp, Artificial Sequence; identical to SEQ ID NO: 3410
  Description of Artificial Sequence: Synthetic polynucleotide

SEQ ID NO: 3474 - DNA, 182 bp, Artificial Sequence; identical to SEQ ID NO: 3411
  Description of Artificial Sequence: Synthetic polynucleotide

SEQ ID NO: 3475 - DNA, 192 bp, Artificial Sequence; identical to SEQ ID NO: 3412
  Description of Artificial Sequence: Synthetic polynucleotide

SEQ ID NO: 3476 - DNA, 202 bp, Artificial Sequence; identical to SEQ ID NO: 3413
  Description of Artificial Sequence: Synthetic polynucleotide

SEQ ID NO: 3477 - DNA, 162 bp, Artificial Sequence; identical to SEQ ID NO: 3414
  Description of Artificial Sequence: Synthetic polynucleotide

SEQ ID NO: 3478 - DNA, 172 bp, Artificial Sequence; identical to SEQ ID NO: 3415
  Description of Artificial Sequence: Synthetic polynucleotide

SEQ ID NO: 3479 - DNA, 182 bp, Artificial Sequence; identical to SEQ ID NO: 3416
  Description of Artificial Sequence: Synthetic polynucleotide

SEQ ID NO: 3480 - DNA, 192 bp, Artificial Sequence; identical to SEQ ID NO: 3417
  Description of Artificial Sequence: Synthetic polynucleotide

SEQ ID NO: 3481 - DNA, 202 bp, Artificial Sequence; identical to SEQ ID NO: 3418
  Description of Artificial Sequence: Synthetic polynucleotide

SEQ ID NO: 3482 - DNA, 162 bp, Artificial Sequence; identical to SEQ ID NO: 3419
  Description of Artificial Sequence: Synthetic polynucleotide

SEQ ID NO: 3483 - DNA, 172 bp, Artificial Sequence; identical to SEQ ID NO: 3420
  Description of Artificial Sequence: Synthetic polynucleotide

SEQ ID NO: 3484 - DNA, 182 bp, Artificial Sequence; identical to SEQ ID NO: 3411
  Description of Artificial Sequence: Synthetic polynucleotide

SEQ ID NO: 3485 - DNA, 182 bp, Artificial Sequence; identical to SEQ ID NO: 3411
  Description of Artificial Sequence: Synthetic polynucleotide

SEQ ID NO: 3486 - DNA, 182 bp, Artificial Sequence; identical to SEQ ID NO: 3411
  Description of Artificial Sequence: Synthetic polynucleotide

SEQ ID NO: 3487 - DNA, 182 bp, Artificial Sequence; identical to SEQ ID NO: 3411
  Description of Artificial Sequence: Synthetic polynucleotide

SEQ ID NO: 3488 - DNA, 182 bp, Artificial Sequence; identical to SEQ ID NO: 3425
  Description of Artificial Sequence: Synthetic polynucleotide

SEQ ID NO: 3489 - DNA, 182 bp, Artificial Sequence; identical to SEQ ID NO: 3426
  Description of Artificial Sequence: Synthetic polynucleotide

SEQ ID NO: 3490 - DNA, 182 bp, Artificial Sequence; identical to SEQ ID NO: 3427
  Description of Artificial Sequence: Synthetic polynucleotide

SEQ ID NO: 3491 - DNA, 182 bp, Artificial Sequence; identical to SEQ ID NO: 3428
  Description of Artificial Sequence: Synthetic polynucleotide

SEQ ID NO: 3492 - DNA, 192 bp, Artificial Sequence; identical to SEQ ID NO: 3429
  Description of Artificial Sequence: Synthetic polynucleotide

SEQ ID NO: 3493 - DNA, 182 bp, Artificial Sequence; identical to SEQ ID NO: 3430
  Description of Artificial Sequence: Synthetic polynucleotide

SEQ ID NO: 3494 - DNA, 192 bp, Artificial Sequence; identical to SEQ ID NO: 3431
  Description of Artificial Sequence: Synthetic polynucleotide

SEQ ID NO: 3495 - DNA, 192 bp, Artificial Sequence; identical to SEQ ID NO: 3432
  Description of Artificial Sequence: Synthetic polynucleotide

SEQ ID NO: 3496 - DNA, 215 bp, Artificial Sequence; identical to SEQ ID NO: 3433
  Description of Artificial Sequence: Synthetic polynucleotide

SEQ ID NO: 3497 - DNA, 215 bp, Artificial Sequence; identical to SEQ ID NO: 3434
  Description of Artificial Sequence: Synthetic polynucleotide

SEQ ID NO: 3498 - DNA, 215 bp, Artificial Sequence; identical to SEQ ID NO: 3435
  Description of Artificial Sequence: Synthetic polynucleotide

SEQ ID NO: 3499 - DNA, 152 bp, Artificial Sequence; identical to SEQ ID NO: 3436
  Description of Artificial Sequence: Synthetic polynucleotide

SEQ ID NO: 3500 - DNA, 157 bp, Artificial Sequence; identical to SEQ ID NO: 3437
  Description of Artificial Sequence: Synthetic polynucleotide

SEQ ID NO: 3501 - DNA, 182 bp, Artificial Sequence; identical to SEQ ID NO: 3438
  Description of Artificial Sequence: Synthetic polynucleotide

SEQ ID NO: 3502 - DNA, 251 bp, Artificial Sequence; identical to SEQ ID NO: 3439
  Description of Artificial Sequence: Synthetic polynucleotide

SEQ ID NO: 3503 - DNA, 261 bp, Artificial Sequence; identical to SEQ ID NO: 3440
  Description of Artificial Sequence: Synthetic polynucleotide

SEQ ID NO: 3504 - DNA, 271 bp, Artificial Sequence; identical to SEQ ID NO: 3441
  Description of Artificial Sequence: Synthetic polynucleotide

SEQ ID NO: 3505 - DNA, 281 bp, Artificial Sequence; identical to SEQ ID NO: 3442
  Description of Artificial Sequence: Synthetic polynucleotide

SEQ ID NO: 3506 - DNA, 261 bp, Artificial Sequence; identical to SEQ ID NO: 3443
  Description of Artificial Sequence: Synthetic polynucleotide

SEQ ID NO: 3507 - DNA, 271 bp, Artificial Sequence; identical to SEQ ID NO: 3444
  Description of Artificial Sequence: Synthetic polynucleotide

SEQ ID NO: 3508 - DNA, 281 bp, Artificial Sequence; identical to SEQ ID NO: 3445
  Description of Artificial Sequence: Synthetic polynucleotide

SEQ ID NO: 3509 - DNA, 261 bp, Artificial Sequence; identical to SEQ ID NO: 3446
  Description of Artificial Sequence: Synthetic polynucleotide

SEQ ID NO: 3510 - DNA, 271 bp, Artificial Sequence; identical to SEQ ID NO: 3447
  Description of Artificial Sequence: Synthetic polynucleotide

SEQ ID NO: 3511 - DNA, 281 bp, Artificial Sequence; identical to SEQ ID NO: 3448
  Description of Artificial Sequence: Synthetic polynucleotide

SEQ ID NO: 3512 - DNA, 210 bp, Artificial Sequence; identical to SEQ ID NO: 3449
  Description of Artificial Sequence: Synthetic polynucleotide

SEQ ID NO: 3513 - DNA, 220 bp, Artificial Sequence; identical to SEQ ID NO: 3450
  Description of Artificial Sequence: Synthetic polynucleotide

SEQ ID NO: 3514 - DNA, 230 bp, Artificial Sequence; identical to SEQ ID NO: 3451
  Description of Artificial Sequence: Synthetic polynucleotide

SEQ ID NO: 3515 - DNA, 240 bp, Artificial Sequence; identical to SEQ ID NO: 3452
  Description of Artificial Sequence: Synthetic polynucleotide

SEQ ID NO: 3516 - DNA, 220 bp, Artificial Sequence; identical to SEQ ID NO: 3453
  Description of Artificial Sequence: Synthetic polynucleotide

SEQ ID NO: 3517 - DNA, 230 bp, Artificial Sequence; identical to SEQ ID NO: 3454
  Description of Artificial Sequence: Synthetic polynucleotide

SEQ ID NO: 3518 - DNA, 240 bp, Artificial Sequence; identical to SEQ ID NO: 3455
  Description of Artificial Sequence: Synthetic polynucleotide

SEQ ID NO: 3519 - DNA, 220 bp, Artificial Sequence; identical to SEQ ID NO: 3456
  Description of Artificial Sequence: Synthetic polynucleotide

SEQ ID NO: 3520 - DNA, 230 bp, Artificial Sequence; identical to SEQ ID NO: 3457
  Description of Artificial Sequence: Synthetic polynucleotide

SEQ ID NO: 3521 - DNA, 240 bp, Artificial Sequence; identical to SEQ ID NO: 3458
  Description of Artificial Sequence: Synthetic polynucleotide

SEQ ID NO: 3522 - DNA, 172 bp, Artificial Sequence; identical to SEQ ID NO: 3459
  Description of Artificial Sequence: Synthetic polynucleotide

SEQ ID NO: 3523 - DNA, 271 bp, Artificial Sequence; identical to SEQ ID NO: 3460
  Description of Artificial Sequence: Synthetic polynucleotide

SEQ ID NO: 3524 - DNA, 281 bp, Artificial Sequence; identical to SEQ ID NO: 3461
  Description of Artificial Sequence: Synthetic polynucleotide

SEQ ID NO: 3525 - DNA, 291 bp, Artificial Sequence; identical to SEQ ID NO: 3462
  Description of Artificial Sequence: Synthetic polynucleotide

SEQ ID NO: 3526 - DNA, 281 bp, Artificial Sequence; identical to SEQ ID NO: 3463
  Description of Artificial Sequence: Synthetic polynucleotide

SEQ ID NO: 3527 - DNA, 291 bp, Artificial Sequence; identical to SEQ ID NO: 3464
  Description of Artificial Sequence: Synthetic polynucleotide

SEQ ID NO: 3528 - DNA, 291 bp, Artificial Sequence; identical to SEQ ID NO: 3465
  Description of Artificial Sequence: Synthetic polynucleotide

SEQ ID NO: 3529 - DNA, 230 bp, Artificial Sequence; identical to SEQ ID NO: 3466
  Description of Artificial Sequence: Synthetic polynucleotide

SEQ ID NO: 3530 - DNA, 240 bp, Artificial Sequence; identical to SEQ ID NO: 3467
  Description of Artificial Sequence: Synthetic polynucleotide

SEQ ID NO: 3531 - DNA, 250 bp, Artificial Sequence; identical to SEQ ID NO: 3468
  Description of Artificial Sequence: Synthetic polynucleotide

SEQ ID NO: 3532 - DNA, 240 bp, Artificial Sequence; identical to SEQ ID NO: 3469
  Description of Artificial Sequence: Synthetic polynucleotide

SEQ ID NO: 3533 - DNA, 250 bp, Artificial Sequence; identical to SEQ ID NO: 3470
  Description of Artificial Sequence: Synthetic polynucleotide

SEQ ID NO: 3534 - DNA, 250 bp, Artificial Sequence; identical to SEQ ID NO: 3471
  Description of Artificial Sequence: Synthetic polynucleotide

SEQ ID NO: 3535 - DNA, 1137 bp, Artificial Sequence
  Description of Artificial Sequence: Synthetic polynucleotide
atgctgctgctggtcacatctctgctgctgtgcgagctgccccatcctgcctttctgctgatccccgacatccagatgacccagaccacaagcagcctgtctgccagcctgggcgatagagtgaccatcagctgtagagccagccaggacatcagcaagtacctgaactggtatcagcaaaagcccgacggcaccgtgaagctgctgatctaccacaccagcagactgcacagcggcgtgccaagcagattttctggcagcggctctggcaccgactacagcctgacaatcagcaacctggaacaagaggatatcgctacctacttctgccagcaaggcaacaccctgccttacacctttggcggaggcaccaagctggaaatcaccggctctacaagcggcagcggcaaacctggatctggcgagggatctaccaagggcgaagtgaaactgcaagagtctggccctggactggtggccccatctcagtctctgagcgtgacctgtacagtcagcggagtgtccctgcctgattacggcgtgtcctggatcagacagcctcctcggaaaggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactattgcgccaagcactactactacggcggcagctacgccatggattattggggccagggcaccagcgtgaccgtttcttctgccgccgctatcgaagtgatgtaccctcctccttacctggacaacgagaagtccaacggcaccatcatccacgtgaagggcaagcacctgtgtccttctccactgttccccggacctagcaagcctttctgggtgctcgttgttgttggcggcgtgctggcctgttacagcctgctggttaccgtggccttcatcatcttttgggtcaagagaggccggaagaaacttctttatatattcaagcagccctttatgcgacccgttcagactacccaagaggaagatggatgcagttgccgctttccagaagaggaggagggcgggtgcgaactgtaa

SEQ ID NO: 3536 - DNA, 1134 bp, Artificial Sequence
  Description of Artificial Sequence: Synthetic polynucleotide
atgctgctgctggtcacatctctgctgctgtgcgagctgccccatcctgcctttctgctgatccccgacatccagatgacccagaccacaagcagcctgtctgccagcctgggcgatagagtgaccatcagctgtagagccagccaggacatcagcaagtacctgaactggtatcagcaaaagcccgacggcaccgtgaagctgctgatctaccacaccagcagactgcacagcggcgtgccaagcagattttctggcagcggctctggcaccgactacagcctgacaatcagcaacctggaacaagaggatatcgctacctacttctgccagcaaggcaacaccctgccttacacctttggcggaggcaccaagctggaaatcaccggctctacaagcggcagcggcaaacctggatctggcgagggatctaccaagggcgaagtgaaactgcaagagtctggccctggactggtggccccatctcagtctctgagcgtgacctgtacagtcagcggagtgtccctgcctgattacggcgtgtcctggatcagacagcctcctcggaaaggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactattgcgccaagcactactactacggcggcagctacgccatggattattggggccagggcaccagcgtgaccgtttcttctgccgccgctatcgaagtgatgtaccctcctccttacctggacaacgagaagtccaacggcaccatcatccacgtgaagggcaagcacctgtgtccttctccactgttccccggacctagcaagcctttctgggtgctcgttgttgttggcggcgtgctggcctgttacagcctgctggttaccgtggccttcatcatcttttgggtccgaagcaagcggagccggctgctgcactccgactacatgaacatgacccctagacggcccggaccaaccagaaagcactaccagccttacgctcctcctagagacttcgccgcctaccggtcctaa

SEQ ID NO: 3537 - DNA, 1470 bp, Artificial Sequence
  Description of Artificial Sequence: Synthetic polynucleotide
atgctgctgctggtcacatctctgctgctgtgcgagctgccccatcctgcctttctgctgatccccgacatccagatgacccagaccacaagcagcctgtctgccagcctgggcgatagagtgaccatcagctgtagagccagccaggacatcagcaagtacctgaactggtatcagcaaaagcccgacggcaccgtgaagctgctgatctaccacaccagcagactgcacagcggcgtgccaagcagattttctggcagcggctctggcaccgactacagcctgacaatcagcaacctggaacaagaggatatcgctacctacttctgccagcaaggcaacaccctgccttacacctttggcggaggcaccaagctggaaatcaccggctctacaagcggcagcggcaaacctggatctggcgagggatctaccaagggcgaagtgaaactgcaagagtctggccctggactggtggccccatctcagtctctgagcgtgacctgtacagtcagcggagtgtccctgcctgattacggcgtgtcctggatcagacagcctcctcggaaaggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactattgcgccaagcactactactacggcggcagctacgccatggattattggggccagggcaccagcgtgaccgtttcttctgccgccgctatcgaagtgatgtaccctcctccttacctggacaacgagaagtccaacggcaccatcatccacgtgaagggcaagcacctgtgtccttctccactgttccccggacctagcaagcctttctgggtgctcgttgttgttggcggcgtgctggcctgttacagcctgctggttaccgtggccttcatcatcttttgggtccgaagcaagcggagccggctgctgcactccgactacatgaacatgacccctagacggcccggaccaaccagaaagcactaccagccttacgctcctcctagagacttcgccgcctaccggtccagagtgaagttcagcagatccgccgatgctcccgcctatcagcagggccaaaaccagctgtacaacgagctgaacctggggagaagagaagagtacgacgtgctggacaagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggactgagcaccgccaccaaggatacctatgacgccctgcacatgcaggccctgcctccaagataa

SEQ ID NO: 3538 - DNA, 1347 bp, Artificial Sequence
  Description of Artificial Sequence: Synthetic polynucleotide
atgctgctgctggtcacatctctgctgctgtgcgagctgccccatcctgcctttctgctgatccccgacatccagatgacccagaccacaagcagcctgtctgccagcctgggcgatagagtgaccatcagctgtagagccagccaggacatcagcaagtacctgaactggtatcagcaaaagcccgacggcaccgtgaagctgctgatctaccacaccagcagactgcacagcggcgtgccaagcagattttctggcagcggctctggcaccgactacagcctgacaatcagcaacctggaacaagaggatatcgctacctacttctgccagcaaggcaacaccctgccttacacctttggcggaggcaccaagctggaaatcaccggctctacaagcggcagcggcaaacctggatctggcgagggatctaccaagggcgaagtgaaactgcaagagtctggccctggactggtggccccatctcagtctctgagcgtgacctgtacagtcagcggagtgtccctgcctgattacggcgtgtcctggatcagacagcctcctcggaaaggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactattgcgccaagcactactactacggcggcagctacgccatggattattggggccagggcaccagcgtgaccgtttcttctgccgccgctatcgaagtgatgtaccctcctccttacctggacaacgagaagtccaacggcaccatcatccacgtgaagggcaagcacctgtgtccttctccactgttccccggacctagcaagcctttctgggtgctcgttgttgttggcggcgtgctggcctgttacagcctgctggttaccgtggccttcatcatcttttgggtcagagtgaagttcagcagatccgccgatgctcccgcctatcagcagggccaaaaccagctgtacaacgagctgaacctggggagaagagaagagtacgacgtgctggacaagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggactgagcaccgccaccaaggatacctatgacgccctgcacatgcaggccctgcctccaagataa

SEQ ID NO: 3539 - DNA, 1461 bp, Artificial Sequence
  Description of Artificial Sequence: Synthetic polynucleotide
atggctctcccggtcacagcccttctcctgcccctggcactcttgctgcatgcggcacgacccgacatccagatgacccagaccacaagcagcctgtctgccagcctgggcgatagagtgaccatcagctgtagagccagccaggacatcagcaagtacctgaactggtatcagcaaaagcccgacggcaccgtgaagctgctgatctaccacaccagcagactgcacagcggcgtgccaagcagattttctggcagcggctctggcaccgactacagcctgacaatcagcaacctggaacaagaggatatcgctacctacttctgccagcaaggcaacaccctgccttacacctttggcggaggcaccaagctggaaatcaccggtggaggtggttctggcggagggggatctggtggaggcggttcagaagtgaaactgcaagagtctggccctggactggtggccccatctcagtctctgagcgtgacctgtacagtcagcggagtgtccctgcctgattacggcgtgtcctggatcagacagcctcctcggaaaggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactattgcgccaagcactactactacggcggcagctacgccatggattattggggccagggcaccagcgtgaccgtttcttctaccacaacgcccgccccgcgaccgcctactcccgctcccacaattgcatcacaacccctgtctttgagacccgaagcttgtcgaccagctgccggtggcgcggttcacacgcgggggctcgatttcgcctgtgatatatatatatgggccccattggctggaacatgcggagtattgcttctgagcctggtgattaccctctactgtaagagaggccggaagaaacttctttatatattcaagcagccctttatgcgacccgttcagactacccaagaggaagatggatgcagttgccgctttccagaagaggaggagggcgggtgcgaactgagagtgaagttcagcagatccgccgatgctcccgcctatcagcagggccaaaaccagctgtacaacgagctgaacctggggagaagagaagagtacgacgtgctggacaagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggactgagcaccgccaccaaggatacctatgacgccctgcacatgcaggccctgcctccaagataa

SEQ ID NO: 3540 - DNA, 1461 bp, Artificial Sequence
  Description of Artificial Sequence: Synthetic polynucleotide
atggctctcccggtcacagcccttctcctgcccctggcactcttgctgcatgcggcacgacccgacatccagatgacccagaccacaagcagcctgtctgccagcctgggcgatagagtgaccatcagctgtagagccagccaggacatcagcaagtacctgaactggtatcagcaaaagcccgacggcaccgtgaagctgctgatctaccacaccagcagactgcacagcggcgtgccaagcagattttctggcagcggctctggcaccgactacagcctgacaatcagcaacctggaacaagaggatatcgctacctacttctgccagcaaggcaacaccctgccttacacctttggcggaggcaccaagctggaaatcaccggtggaggtggttctggcggagggggatctggtggaggcggttcagaagtgaaactgcaagagtctggccctggactggtggccccatctcagtctctgagcgtgacctgtacagtcagcggagtgtccctgcctgattacggcgtgtcctggatcagacagcctcctcggaaaggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactattgcgccaagcactactactacggcggcagctacgccatggattattggggccagggcaccagcgtgaccgtttcttctaccacaacgcccgccccgcgaccgcctactcccgctcccacaattgcatcacaacccctgtctttgagacccgaagcttgtcgaccagctgccggtggcgcggttcacacgcgggggctcgatttcgcctgtgatatatatatatgggccccattggctggaacatgcggagtattgcttctgagcctggtgattaccctctactgtaagagaggccggaagaaacttctttatatattcaagcagccctttatgcgacccgttcagactacccaagaggaagatggatgcagttgccgctttccagaagaggaggagggcgggtgcgaactgagagtgaagttcagcagatccgccgatgctcccgcctataagcagggccaaaaccagctgtacaacgagctgaacctggggagaagagaagagtacgacgtgctggacaagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggactgagcaccgccaccaaggatacctatgacgccctgcacatgcaggccctgcctccaagataa

SEQ ID NO: 3541 - DNA, 1452 bp, Artificial Sequence
  Description of Artificial Sequence: Synthetic polynucleotide
atgctgctgctggtcacatctctgctgctgtgcgagctgccccatcctgcctttctgctgatcccccaggttcaactccagcagtctggtcccggcctcgttaaaccaagccagactttgtctcttacctgtgctatcagtggcgatagcgtgtctagtaattcagccgcatggaactggatccgacaatcaccgagtaggggacttgaatggctgggtagaacctattaccggtccaaatggtacaatgactatgcagtgtctgtaaaaagcaggatcacgatcaaccctgatacgtctaaaaaccagttttctctgcaacttaatagtgtgacccctgaagacaccgctgtgtattactgtgcacgggaggttaccggtgatcttgaagatgcttttgatatatggggccaaggtacgatggtcacggtgtctagtgggggaggcggcagcgacatacagatgacgcagagcccatccagtctctccgcgtctgttggtgacagagtgactattacatgtagggcgtctcagaccatttggtcttacctcaattggtatcaacagcgaccaggcaaagcaccgaacttgctcatttacgctgccagctcactccaaagtggtgtgccgtccagatttagtggtaggggcagtggcactgatttcactctgactatttcaagtcttcaagctgaggattttgccacatactactgccagcaaagttactcaatacctcagacttttggacaggggacaaaattggagattaaatccggaaccacaacgcccgccccgcgaccgcctactcccgctcccacaattgcatcacaacccctgtctttgagacccgaagcttgtcgaccagctgccggtggcgcggttcacacgcgggggctcgatttcgcctgtgatatatatatatgggccccattggctggaacatgcggagtattgcttctgagcctggtgattaccctctactgtaagagaggccggaagaaacttctttatatattcaagcagccctttatgcgacccgttcagactacccaagaggaagatggatgcagttgccgctttccagaagaggaggagggcgggtgcgaactgagagtgaagttcagcagatccgccgatgctcccgcctataagcagggccaaaaccagctgtacaacgagctgaacctggggagaagagaagagtacgacgtgctggacaagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggactgagcaccgccaccaaggatacctatgacgccctgcacatgcaggccctgcctccaagataa

SEQ ID NO: 3542 - DNA, 2202 bp, Artificial Sequence
  Description of Artificial Sequence: Synthetic polynucleotide
atgctgctgctggtcacatctctgctgctgtgcgagctgccccatcctgcctttctgctgatccccgacatccagatgacccagaccacaagcagcctgtctgccagcctgggcgatagagtgaccatcagctgtagagccagccaggacatcagcaagtacctgaactggtatcagcaaaagcccgacggcaccgtgaagctgctgatctaccacaccagcagactgcacagcggcgtgccaagcagattttctggcagcggctctggcaccgactacagcctgacaatcagcaacctggaacaagaggatatcgctacctacttctgccagcaaggcaacaccctgccttacacctttggcggaggcaccaagctggaaatcaccggcggcggaggatcccaggttcaactccagcagtctggtcccggcctcgttaaaccaagccagactttgtctcttacctgtgctatcagtggcgatagcgtgtctagtaattcagccgcatggaactggatccgacaatcaccgagtaggggacttgaatggctgggtagaacctattaccggtccaaatggtacaatgactatgcagtgtctgtaaaaagcaggatcacgatcaaccctgatacgtctaaaaaccagttttctctgcaacttaatagtgtgacccctgaagacaccgctgtgtattactgtgcacgggaggttaccggtgatcttgaagatgcttttgatatatggggccaaggtacgatggtcacggtgtctagtggctctacaagcggcagcggcaaacctggatctggcgagggatctaccaagggcgacatacagatgacgcagagcccatccagtctctccgcgtctgttggtgacagagtgactattacatgtagggcgtctcagaccatttggtcttacctcaattggtatcaacagcgaccaggcaaagcaccgaacttgctcatttacgctgccagctcactccaaagtggtgtgccgtccagatttagtggtaggggcagtggcactgatttcactctgactatttcaagtcttcaagctgaggattttgccacatactactgccagcaaagttactcaatacctcagacttttggacaggggacaaaattggagattaaagggggaggcggcagcgaagtgaaactgcaagagtctggccctggactggtggccccatctcagtctctgagcgtgacctgtacagtcagcggagtgtccctgcctgattacggcgtgtcctggatcagacagcctcctcggaaaggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactattgcgccaagcactactactacggcggcagctacgccatggattattggggccagggcaccagcgtgaccgtttcttcttccggaaccacaacgcccgccccgcgaccgcctactcccgctcccacaattgcatcacaacccctgtctttgagacccgaagcttgtcgaccagctgccggtggcgcggttcacacgcgggggctcgatttcgcctgtgatatatatatatgggccccattggctggaacatgcggagtattgcttctgagcctggtgattaccctctactgtaagagaggccggaagaaacttctttatatattcaagcagccctttatgcgacccgttcagactacccaagaggaagatggatgcagttgccgctttccagaagaggaggagggcgggtgcgaactgagagtgaagttcagcagatccgccgatgctcccgcctataagcagggccaaaaccagctgtacaacgagctgaacctggggagaagagaagagtacgacgtgctggacaagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggactgagcaccgccaccaaggatacctatgacgccctgcacatgcaggccctgcctccaagataa

SEQ ID NO: 3543 - DNA, 2262 bp, Artificial Sequence
  Description of Artificial Sequence: Synthetic polynucleotide
atgctgctgctggtcacatctctgctgctgtgcgagctgccccatcctgcctttctgctgatcccccaggttcaactccagcagtctggtcccggcctcgttaaaccaagccagactttgtctcttacctgtgctatcagtggcgatagcgtgtctagtaattcagccgcatggaactggatccgacaatcaccgagtaggggacttgaatggctgggtagaacctattaccggtccaaatggtacaatgactatgcagtgtctgtaaaaagcaggatcacgatcaaccctgatacgtctaaaaaccagttttctctgcaacttaatagtgtgacccctgaagacaccgctgtgtattactgtgcacgggaggttaccggtgatcttgaagatgcttttgatatatggggccaaggtacgatggtcacggtgtctagtgggggaggcggcagcgacatacagatgacgcagagcccatccagtctctccgcgtctgttggtgacagagtgactattacatgtagggcgtctcagaccatttggtcttacctcaattggtatcaacagcgaccaggcaaagcaccgaacttgctcatttacgctgccagctcactccaaagtggtgtgccgtccagatttagtggtaggggcagtggcactgatttcactctgactatttcaagtcttcaagctgaggattttgccacatactactgccagcaaagttactcaatacctcagacttttggacaggggacaaaattggagattaaagggggaggcggatccggcggtggtggctccggcggtggtggttctggaggcggcggaagcggtgggggtggtagcgacatccagatgacccagaccacaagcagcctgtctgccagcctgggcgatagagtgaccatcagctgtagagccagccaggacatcagcaagtacctgaactggtatcagcaaaagcccgacggcaccgtgaagctgctgatctaccacaccagcagactgcacagcggcgtgccaagcagattttctggcagcggctctggcaccgactacagcctgacaatcagcaacctggaacaagaggatatcgctacctacttctgccagcaaggcaacaccctgccttacacctttggcggaggcaccaagctggaaatcaccggctctacaagcggcagcggcaaacctggatctggcgagggatctaccaagggcgaagtgaaactgcaagagtctggccctggactggtggccccatctcagtctctgagcgtgacctgtacagtcagcggagtgtccctgcctgattacggcgtgtcctggatcagacagcctcctcggaaaggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactattgcgccaagcactactactacggcggcagctacgccatggattattggggccagggcaccagcgtgaccgtttcttcttccggaaccacaacgcccgccccgcgaccgcctactcccgctcccacaattgcatcacaacccctgtctttgagacccgaagcttgtcgaccagctgccggtggcgcggttcacacgcgggggctcgatttcgcctgtgatatatatatatgggccccattggctggaacatgcggagtattgcttctgagcctggtgattaccctctactgtaagagaggccggaagaaacttctttatatattcaagcagccctttatgcgacccgttcagactacccaagaggaagatggatgcagttgccgctttccagaagaggaggagggcgggtgcgaactgagagtgaagttcagcagatccgccgatgctcccgcctataagcagggccaaaaccagctgtacaacgagctgaacctggggagaagagaagagtacgacgtgctggacaagcggagaggcagagatcctgaaatgggcggcaagcccagacggaagaatcctcaagagggcctgtataatgagctgcagaaagacaagatggccgaggcctacagcgagatcggaatgaagggcgagcgcagaagaggcaagggacacgatggactgtaccagggactgagcaccgccaccaaggatacctatgacgccctgcacatgcaggccctgcctccaagataa

SEQ ID NO: 3544 - protein, 42 aa, Artificial Sequence
  Description of Artificial Sequence: Synthetic polynucleotide
KRGRKKLLYIFKQPFMRPVQTTQEEDGCSCRFPEEEEGGCEL

SEQ ID NO: 3545 - protein, 112 aa, Artificial Sequence
  Description of Artificial Sequence: Synthetic polynucleotide
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 3546 - protein, 241 aa, Artificial Sequence
  Description of Artificial Sequence: Synthetic polynucleotide
QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 3547 - protein, 120 aa, Artificial Sequence
  Description of Artificial Sequence: Synthetic polynucleotide
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 3548 - protein, 107 aa, Artificial Sequence
  Description of Artificial Sequence: Synthetic polynucleotide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIT

SEQ ID NO: 3549 - protein, 447 aa, Artificial Sequence
  Description of Artificial Sequence: Synthetic polynucleotide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3550 - protein, 218 aa, Artificial Sequence
  Description of Artificial Sequence: Synthetic polynucleotide
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3551 - protein, 440 aa, Artificial Sequence
  Description of Artificial Sequence: Synthetic polynucleotide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3552 - protein, 214 aa, Artificial Sequence
  Description of Artificial Sequence: Synthetic polynucleotide
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3553 - protein, 448 aa, Artificial Sequence
  Description of Artificial Sequence: Synthetic polynucleotide
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3554 - protein, 214 aa, Artificial Sequence
  Description of Artificial Sequence: Synthetic polynucleotide
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3555 - protein, 450 aa, Artificial Sequence
  Description of Artificial Sequence: Synthetic polynucleotide
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3556 - protein, 216 aa, Artificial Sequence
  Description of Artificial Sequence: Synthetic polynucleotide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 3557 - protein, 451 aa, Artificial Sequence
  Description of Artificial Sequence: Synthetic polynucleotide
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3558 - protein, 215 aa, Artificial Sequence
  Description of Artificial Sequence: Synthetic polynucleotide
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3559 - protein, 133 aa, Homo sapiens [sequence omitted]

SEQ ID NO: 3560 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 3561 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 3562 - protein, 152 aa, Homo sapiens
DCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 3563 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 3564 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 3565 - protein, 157 aa, Homo sapiens
YFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 3566 - protein, 209 aa, Homo sapiens
RKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 3567 - protein, 138 aa, Homo sapiens
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 3568 - protein, 112 aa, Homo sapiens
ALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 3569 - protein, 133 aa, Homo sapiens [sequence omitted]

SEQ ID NO: 3570 - protein, 197 aa, Homo sapiens; identical to SEQ ID NO: 3560

SEQ ID NO: 3571 - protein, 306 aa, Homo sapiens; identical to SEQ ID NO: 3561

SEQ ID NO: 3572 - protein, 152 aa, Homo sapiens; identical to SEQ ID NO: 3562

SEQ ID NO: 3573 - protein, 160 aa, Homo sapiens; identical to SEQ ID NO: 3563

SEQ ID NO: 3574 - protein, 114 aa, Homo sapiens; identical to SEQ ID NO: 3564

SEQ ID NO: 3575 - protein, 157 aa, Homo sapiens; identical to SEQ ID NO: 3565

SEQ ID NO: 3576 - protein, 209 aa, Homo sapiens; identical to SEQ ID NO: 3566

SEQ ID NO: 3577 - protein, 138 aa, Homo sapiens; identical to SEQ ID NO: 3567

SEQ ID NO: 3578 - protein, 112 aa, Homo sapiens; identical to SEQ ID NO: 3568

SEQ ID NO: 3579 - protein, 431 aa, Homo sapiens
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 3580 - protein, 417 aa, Homo sapiens
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKR

SEQ ID NO: 3581 - protein, 366 aa, Homo sapiens
GGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKR

SEQ ID NO: 3582 - protein, 787 aa, Homo sapiens
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQAQFGPLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNDYSGEILNNCCVMEYHQATGTLSAHFRNMSLKRIKRSDRRGAESVTEEKFTILFESQFSVGGNELVFQVKTLSLPVVVIVHGSQDNNATATVLWDNAFAEPGRVPFAVPDKVLWPQLCEALNMKFKAEVQSNRGLTKENLVFLAQKLFNNSSSHLEDYSGLSVSWSQFNRENLPGRNYTFWQWFDGVMEVLKKHLKPHWNDGAILGFVNKQQAHDLLINKPDGTFLLRFSDSEIGGITIAWKFDSQERMFWNLMPFTTRDFSIRSLADRLGDLNYLIYVFPDRPKDEVYSKYYTPVPCESATAKAVDGYVKPQIKQVVPEFVNASADAGGGSATYMDQAPSPAVCPQAHYNMYPQNPDSVLDTDGDFDLEDTMDVARRVEELLGRPMDSQWIPHAQS

SEQ ID NO: 3583 - protein, 526 aa, Homo sapiens [sequence omitted]

SEQ ID NO: 3584 - DNA, 167 bp, Artificial Sequence
  Description of Artificial Sequence: Synthetic polynucleotide
ccctgcagccgtcaccgtaagtttgaagttaccgcatatcagcctctgcttcccagcgcgtccaattcctgttcttattgtttcccctccaggcgttacgcgtgacgacgaactgtgtcgcagctaccacattattccggagccttcattctcgcggctctgatcgt

SEQ ID NO: 3585 - DNA, 43 bp, Artificial Sequence
  Description of Artificial Sequence: Synthetic polynucleotide
ggagaccgcggccacgccgagtaggatcgagggtacagtctcc

SEQ ID NO: 3586 - DNA, 167 bp, Artificial Sequence
  Description of Artificial Sequence: Synthetic polynucleotide
gacaccaggatcactcttgctctgacccgccctgtgtagaatagactcatgcttccctaagacctggatttcttcccaggcactttcacccgcctgccctgctccttcagtggactgcacccagggaggcggtctctgactgtcctttactttctattctggattgc

SEQ ID NO: 3587 - DNA, 30 bp, Artificial Sequence
  Description of Artificial Sequence: Synthetic polynucleotide
aaacccccctaagccgccgccgccgccacc

SEQ ID NO: 3588 - DNA, 18 bp, Artificial Sequence
  Description of Artificial Sequence: Synthetic polynucleotide
cccccccaacccgtcacg

SEQ ID NO: 3589 - DNA, 6 bp, Artificial Sequence
  Description of Artificial Sequence: Synthetic polynucleotide
gtcacg

SEQ ID NO: 3590 - DNA, 141 bp, Artificial Sequence
  Description of Artificial Sequence: Synthetic polynucleotide
tctgcgcactcgtaatcagtactaacccccctttgtcggacactatgcgataatcgatccgcctttttcaccgccttcggaattttatttacctcaactgatcctggagtctctcttggttttcacggaggcctccgccca

SEQ ID NO: 3591 - DNA, 43 bp, Artificial Sequence; identical to SEQ ID NO: 3585
  Description of Artificial Sequence: Synthetic polynucleotide

SEQ ID NO: 3592 - DNA, 141 bp, Artificial Sequence
  Description of Artificial Sequence: Synthetic polynucleotide
ccccttgaaacccccgccccaggttcagtctctcttcatccctctgtcctgcatggtgatacaaagaccctttgtggaccctaagccatgtagttgctgctccctccttccagttgtgaatattggtttctgttaatcaca

SEQ ID NO: 3593 - DNA, 30 bp, Artificial Sequence; identical to SEQ ID NO: 3587
  Description of Artificial Sequence: Synthetic polynucleotide

SEQ ID NO: 3594 - DNA, 18 bp, Artificial Sequence
  Description of Artificial Sequence: Synthetic polynucleotide
cccccccaacccgtcacg

SEQ ID NO: 3595 - DNA, 6 bp, Artificial Sequence
  Description of Artificial Sequence: Synthetic polynucleotide
gtcacg

SEQ ID NO: 3596 - DNA, 6 bp, Artificial Sequence
  Description of Artificial Sequence: Synthetic polynucleotide
gtcacg

SEQ ID NO: 3597 - DNA, 43 bp, Artificial Sequence
  Description of Artificial Sequence: Synthetic polynucleotide
aataagagagaaaagaagagtaagaagaaatataagagccacc

SEQ ID NO: 3598 - DNA, 49 bp, Artificial Sequence
  Description of Artificial Sequence: Synthetic polynucleotide
cgaactagtattcttctggtccccacagactcagagagaacccgccacc

SEQ ID NO: 3599 - DNA, 7 bp, Artificial Sequence
  Description of Artificial Sequence: Synthetic polynucleotide
agccacc

SEQ ID NO: 3600 - DNA, 14 bp, Artificial Sequence
  Description of Artificial Sequence: Synthetic polynucleotide
tgatagctaactag

SEQ ID NO: 3601 - DNA, 14 bp, Artificial Sequence
  Description of Artificial Sequence: Synthetic polynucleotide
tagtagctaactag

SEQ ID NO: 3602 - DNA, 14 bp, Artificial Sequence
  Description of Artificial Sequence: Synthetic polynucleotide
tgatgactgagtga

SEQ ID NO: 3603 - DNA, 14 bp, Artificial Sequence
  Description of Artificial Sequence: Synthetic polynucleotide
tagtagctaggtag

SEQ ID NO: 3604 - DNA, 3 bp, Artificial Sequence
  Description of Artificial Sequence: Synthetic polynucleotide
taa

SEQ ID NO: 3605 - DNA, 14 bp, Artificial Sequence
  Description of Artificial Sequence: Synthetic polynucleotide
taatagctaactag

SEQ ID NO: 3606 - DNA, 15 bp, Artificial Sequence
  Description of Artificial Sequence: Synthetic polynucleotide
taactagctaactag

SEQ ID NO: 3607 - protein, 329 aa, Brucella ceti
MKFGSKIRRLAVAAVAGAIALGASFAVAQAPTFFRIGTGGTAGTYYPIGGLIANAISGAGEKGVPGLVATAVSSNGSVANINAIKSGALESGFTQSDVAYWAYNGTGLYDGKGKVEDLRLLATLYPETIHIVARKDANIKSVADLKGKRVSLDEPGSGTIVDARIVLEAYGLTEDDIKAEHLKPGPAGERLKDGALDAYFFVGGYPTGAISELAISNGISLVPISGPEADKILEKYSFFSKDVVPAGAYKDVAETPTLAVAAQWVTSAKQPDDLIYNITKVLWNEDTRKALDAGHAKGKLIKLDSATSSLGIPLHPGAERFYKEAGVLK

SEQ ID NO: 3608 - protein, 402 aa, Chlamydia psittaci
MKKLLKSALLFAATGSALSLQALPVGNPAEPSLLIDGTMWEGASGDPCDPCATWCDAISIRAGYYGDYVFDRVLKVDVNKTFSGMAATPTQATGNASNTNQPEANGRPNIAYGRHMQDAEWFSNAAFLALNIWDRFDIFCTLGASNGYFKASSAAFNLVGLIGFSAASSISTDLPMQLPNVGITQGVVEFYTDTSFSWSVGARGALWECGCATLGAEFQYAQSNPKIEMLNVTSSPAQFVIHKPRGYKGASSNFPLPITAGTTEATDTKSATIKYHEWQVGLALSYRLNMLVPYIGVNWSRATFDADTIRIAQPKLKSEILNITTWNPSLIGSTTALPNNSGKDVLSDVLQIASIQINKMKSRKACGVAVGATLIDADKWSITGEARLINERAAHMNAQFRF

SEQ ID NO: 3609 - protein, 370 aa, Fusobacterium nucleatum
MKKLALVLGLLLVVGSVASAKEVMPAPTPAPEKVVEYVEKPVIVYRDREVAPAWRPNGSVDVQYRWYGEVEKKNPKDDKDENWATGKVNAGRLQTLTKVNFTEKQTLEVRTRNHHTLNDTDANNKKSNGAADEYRLRHFYNFGKLGSSKVNATSRVEFKQKTNDGEKSLGASVLFDFADYIYSNNFFKVDKLGLRPGYKYVWKGHGNGEEGTPTVHNEYHLAFESDFTLPFNFALNLEYDLSYNRYREKFETTDGLKKAEWYGELTAVLSNYTPLYKAGAFELGFNAEGGYDTYNMHQYKRIGGEDGTSVDRRDYELYLEPTLQVSYKPTDFVKLYAAAGADYRNRITGESEVKRWRWQPTASAGMKVTF

SEQ ID NO: 3610 - protein, 495 aa, Mycobacterium tuberculosis
MNQHFDVLIIGAGLSGIGTACHVTAEFPDKTIALLERRERLGGTWDLFRYPGVRSDSDMFTFGYKFRPWRDVKVLADGASIRQYIADTATEFGVDEKIHYGLKVNTAEWSSRQCRWTVAGVHEATGETRTYTCDYLISCTGYYNYDAGYLPDFPGVHRFGGRCVHPQHWPEDLDYSGKKVVVIGSGATAVTLVPAMAGSNPGSAAHVTMLQRSPSYIFSLPAVDKISEVLGRFLPDRWVYEFGRRRNIAIQRKLYQACRRWPKLMRRLLLWEVRRRLGRSVDMSNFTPNYLPWDERLCAVPNGDLFKTLASGAASVVTDQIETFTEKGILCKSGREIEADIIVTATGLNIQMLGGMRLIVDGAEYQLPEKMTYKGVLLENAPNLAWIIGYTNASWTLKSDIAGAYLCRLLRHMADNGYTVATPRDAQDCALDVGMFDQLNSGYVKRGQDIMPRQGSKHPWRVLMHYEKDAKILLEDPIDDGVLHFAAAAQDHAAA

SEQ ID NO: 3611 - protein, 95 aa, Neisseria gonorrhoeae
MTEQQWNFAGIEAAASAIQGNVTSIHSLLDEGKQSLTKLAAAWGGSGSEAYQGVQQKWDATATELNNALQNLARTISEAGQAMASTEGNVTGMFA

SEQ ID NO: 3612 - protein, 311 aa, Neisseria gonorrhoeae
MKKSLIALTLAALPVAAMADVTLYGTIKAGVETYRFVAHNGAQASGVETATEIADLGSKIGFKGQEDLGNGLKAIWQLEQKAYVSGTNTGWGNRQSFIGLKGGFGKVRVGRLNSVLKDTGGFNPWEGKSEYLSLSNIARPEERPISVRYDSPEFAGFSGSVQYVPNDNSGENKSESYHAGFNYKNSGFFVQYAGSYKRHNYTTEKHQIHRLVGGYDHDALYASVAVQQQDAKLAWPDDNSHNSQTEVATTVAYRFGNVTPRVSYAHGFKGSVYEANHDNTYDQVVVGAEYDFSKRTSALVSAGWLQEGKGA

SEQ ID NO: 3613 - protein, 107 aa, Staphylococcus aureus
FVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 3614 - protein, 301 aa, Rhodobacter capsulatus
EVKLSGDARMGVMYNGDDWNFSSRSRVLFTMSGTTDSGLEFGASFKAHESVGAETGEDGTVFLSGAFGKIEMGDALGASEALFGDLYEVGYTDLDDRGGNDIPYLTGDERLTAEDNPVLLYTYSAGAFSVAASMSDGKVGETSEDDAQEMAVAAAYTFGNYTVGLGYEKIDSPDTALMADMEQLELAAIAKFGATNVKAYYADGELDRDFARAVFDLTPVAAAATAVDHKAYGLSVDSTFGATTVGGYVQVLDIDTIDDVTYYGLGASYDLGGGASIVGGIADNDLPNSDMVADLGVKFKF

SEQ ID NO: 3615 - protein, 346 aa, Escherichia coli
MKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 3616 - protein, 87 aa, Chlamydia pneumoniae
AGVATATGTKSATINYHEWQVGASLSYRLNSLVPYIGVQWSRATFDADNIRIAQPKLPTAVLNLTAWNPSLLGNATALSTTDSFSDF

SEQ ID NO: 3617 - protein, 631 aa, Streptococcus pyogenes
MTTYQDDFYQAVNGKWAETAVIPDDKPRTGGFSDLADEIEALMLDTTDAWLAGENIPDDAILKNFVKFHRLVADYAKRDEVGVSPILPLIEEYQSLKSFSEFVANIAKYELAGLPNEFPFSVAPDFMNAQLNVLWAEAPSILLPDTTYYEEGNEKAEELRGIWRQSQEKLLPQFGFSTEEIKDLLDKVIELDKQLAKYVLSREEGSEYAKLYHPYVWADFKKLAPELPLDSIFEKILGQVPDKVIVPEERFWTEFAATYYSEANWDLLKANLIVDAANAYNAYLTDDIRVESGAYSRALSGTPQAMDKQKAAFYLAQGPFSQALGLWYAGQKFSPEAKADVESKVARMIEVYKSRLETADWLAPATREKAITKLNVITPHIGYPEKLPETYAKKVIDESLSLVENAQNLAKITIAHTWSKWNKPVDRSEWHMPAHLVNAYYDPQQNQIVFPAAILQEPFYSLDQSSSANYGGIGAVIAHEISHAFDTNGASFDEHGSLNDWWTQEDYAAFKERTDKIVAQFDGLESHGAKVNGKLTVSENVADLGGVACALEAAQSEEDFSARDFFINFATIWRMKAREEYMQMLASIDVHAPGELRTNVTLTNFDAFHETFDIKEGDAMWRAPKDRVIIW

SEQ ID NO: 3618 - protein, 341 aa, Vibrio cholerae
MNKTLIALAVSAAAVATGAYADGINQSGDKAGSTVYSAKGTSLEVGGRAEARLSLKDGKAQDNSRVRLNFLGKAEINDSLYGVGFYEGEFTTNDQGKNASNNSLDNRYTYAGIGGTYGEVTYGKNDGALGVITDFTDIMSYHGNTAAEKIAVADRVDNMLAYKGQFGDLGVKASYRFADRNAVDAMGNVVTETNAAKYSDNGEDGYSLSAIYTFGDTGFNVGAGYADQDDQNEYMLAASYRMENLYFAGLFTDGELAKDVDYTGYELAAGYKLGQAAFTATYNNAETAKETSADNFAIDATYYFKPNFRSYISYQFNLLDSDKVGKVASEDELAIGLRYDF

SEQ ID NO: 3619 - protein, 160 aa, Mycobacterium tuberculosis
MKGGAGVPDLPSLDASGVRLAIVASSWHGKICDALLDGARKVAAGCGLDDPTVVRVLGAIEIPVVAQELARNHDAVVALGVVIRGQTPHFDYVCDAVTQGLTRVSLDSSTPIANGVLTTNTEEQALDRAGLPTSAEDKGAQATVAALATALTLRELRAHS

SEQ ID NO: 3620 - protein, 150 aa, Pasteurella multocida
MKKLTKVLLVAGSVAVLAACGSSKKDESAGQMFGGYSVQDLQQRYNTVYFGFDKYNIEGEYVQILDAHAAFLNATPATKVVVEGNTDERGTPEYNIALGQRRADAVKHYLSAKGVQAGQVSTVSYGEEKPAVLGHDEAAYSKNRRAVLAY

SEQ ID NO: 3621 - protein, 177 aa, Brucella melitensis
MGISKASLLSLAAAGIVLAGCQSSRLGNLDNVSPPPPPAPVNAVPAGTVQKGNLDSPTQFPNAPSTDMSAQSGTQVASLPPASAPDLTPGAVAGVWNASLGGQSCKIATPQTKYGQGYRAGPLRCPGELANLASWAVNGKQLVLYDANGGTVASLYSSGQGRFDGQTTGGQAVTLSR

SEQ ID NO: 3622 - protein, 359 aa, Escherichia coli
MQILADLLNTIPAIDSTAMSRAQRHIDGLLKPVGSLGKLEVLAIQLAGMPGLNGIPHVGKKAVLVMCADHGVWEEGVAISPKEVTAIQAENMTRGTTGVCVLAEQAGANVHVIDVGIDTAEPIPGLINMRVARGSGNIASAPAMSRRQAEKLLLDVICYTQELAKNGVTLFGVGELGMANTTPAAAIVSTITGRDPEEVVGIGANLPTDKLANKIDVVRRAITLNQPNPQDGVDVLAKVGGFDLVGIAGVMLGAASCGLPVLLDGFLSYAAALAACQMSPAIKPYLIPSHLSAEKGARIALSHLGLEPYLNMEMRLGEGSGAALAMPIIEAACAIYNNMGELAASNIVLPGNTTSDLNS

SEQ ID NO: 3623 - protein, 172 aa, Mycobacterium tuberculosis
MKNARTTLIAAAIAGTLVTTSPAGIANADDAGLDPNAAAGPDAVGFDPNLPPAPDAAPVDTPPAPEDAGFDPNLPPPLAPDFLSPPAEEAPPVPVAYSVNWDAIAQCESGGNWSINTGNGYYGGLRFTAGTWRANGGSGSAANASREEQIRVAENVLRSQGIRAWPVCGRRG

SEQ ID NO: 3624 - protein, 130 aa, Mycobacterium tuberculosis
MAKLSTDELLDAFKEMTLLELSDFVKKFEETFEVTAAAPVAVAAAGAAPAGAAVEAAEEQSEFDVILEAAGDKKIGVIKVVREIVSGLGLKEAKDLVDGAPKPLLEKVAKEAADEAKAKLEAAGATVTVK

SEQ ID NO: 3625 - protein, 199 aa, Mycobacterium tuberculosis
MAENSNIDDIKAPLLAALGAADLALATVNELITNLRERAEETRTDTRSRVEESRARLTKLQEDLPEQLTELREKFTAEELRKAAEGYLEAATSRYNELVERGEAALERLRSQQSFEEVSARAEGYVDQAVELTQEALGTVASQTRAVGERAAKLVGIELPKKAAPAKKAAPAKKAAPAKKAAAKKAPAKKAAAKKVTQK

SEQ ID NO: 3626 - protein, 594 aa, Neisseria meningitidis
MNKIYRIIWNSALNAWVAVSELTRNHTKRASATVATAVLATLLFATVQASTTDDDDLYLEPVQRTAVVLSFRSDKEGTGEKEVTEDSNWGVYFDKKGVLTAGTITLKAGDNLKIKQNTNENTNASSFTYSLKKDLTDLTSVGTEKLSFSANSNKVNITSDTKGLNFAKKTAETNGDTTVHLNGIGSTLTDTLLNTGATTNVTNDNVTDDEKKRAASVKDVLNAGWNIKGVKPGTTASDNVDFVRTYDTVEFLSADTKTTTVNVESKDNGKRTEVKIGAKTSVIKEKDGKLVTGKDKGENDSSTDKGEGLVTAKEVIDAVNKAGWRMKTTTANGQTGQADKFETVTSGTNVTFASGKGTTATVSKDDQGNITVMYDVNVGDALNVNQLQNSGWNLDSKAVAGSSGKVISGNVSPSKGKMDETVNINAGNNIEITRNGKNIDIATSMTPQFSSVSLGAGADAPTLSVDDEGALNVGSKDANKPVRITNVAPGVKEGDVTNVAQLKGVAQNLNNHIDNVDGNARAGIAQAIATAGLVQAYLPGKSMMAIGGGTYRGEAGYAIGYSSISDGGNWIIKGTASGNSRGHFGASASVGYQW

SEQ ID NO: 3627 - protein, 376 aa, Escherichia coli
MAKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETPVGLNERQKQLLQELQESFGGPTGEHNSPRSKSFFDGVKKFFDDLTR

SEQ ID NO: 3628 - protein, 471 aa, Streptococcus pneumoniae
MANKAVNDFILAMNYDKKKLLTHQGESIENRFIKEGNQLPDEFVVIERKKRSLSTNTSDISVTATNDSRLYPGALLVVDETLLENNPTLLAVDRAPMTYSIDLPGLASSDSFLQVEDPSNSSVRGAVNDLLAKWHQDYGQVNNVPARMQYEKITAHSMEQLKVKFGSDFEKTGNSLDIDFNSVHSGEKQIQIVNFKQIYYTVSVDAVKNPGDVFQDTVTVEDLKQRGISAERPLVYISSVAYGRQVYLKLETTSKSDEVEAAFEALIKGVKVAPQTEWKQILDNTEVKAVILGGDPSSGARVVTGKVDMVEDLIQEGSRFTADHPGLPISYTTSFLRDNVVATFQNSTDYVETKVTAYRNGDLLLDHSGAYVAQYYITWDELSYDHQGKEVLTPKAWDRNGQDLTAHFTTSIPLKGNVRNLSVKIRECTGLAWEWWRTVYEKTDLPLVRKRTISIWGTTLYPQVEDKVEND

SEQ ID NO: 3629 - protein, 498 aa, Escherichia coli
MAQVINTNSLSLITQNNINKNQSALSSSIERLSSGLRINSAKDDAAGQAIANRFTSNIKGLTQAARNANDGISVAQTTEGALSEINNNLQRVRELTVQATTGTNSESDLSSIQDEIKSRLDEIDRVSGQTQFNGVNVLAKNGSMKIQVGANDNQTITIDLKQIDAKTLGLDGFSVKNNDTVTTSAPVTAFGATTTNNIKLTGITLSTEAATDTGGTNPASIEGVYTDNGNDYYAKITGGDNDGKYYAVTVANDGTVTMATGATANATVTDANTTKATTITSGGTPVQIDNTAGSATANLGAVSLVKLQDSKGNDTDTYALKDTNGNLYAADVNETTGAVSVKTITYTDSSGAASSPTAVKLGGDDGKTEVVDIDGKTYDSADLNGGNLQTGLTAGGEALTAVANGKTTDPLKALDDAIASVDKFRSSLGAVQNRLDSAVTNLNNTTTNLSEAQSRIQDADYATEVSNMSKAQIIQQAGNSVLAKANQVPQQVLSLLQG

SEQ ID NO: 3630 - protein, 189 aa, Homo sapiens
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 3631 - protein, 166 aa, Homo sapiens
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 3632 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 3633 - protein, 39 aa, Homo sapiens
MWPPGSASQPPPSPAAATGLHPAARPVSLQCRLSMCPAR

SEQ ID NO: 3634 - protein, 338 aa, Homo sapiens [sequence omitted]

SEQ ID NO: 3635 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 3636 - protein, 193 aa, Homo sapiens
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 3637 - protein, 162 aa, Homo sapiens
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 3638 - protein, 144 aa, Homo sapiens
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 3639 - protein, 269 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 3640 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 3641 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 3642 - protein, 177 aa, Homo sapiens
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 3643 - protein, 155 aa, Homo sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 3644 - skipped

SEQ ID NO: 3645 - protein, 235 aa, Homo sapiens
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 3646 - protein, 448 aa, Artificial Sequence
  Description of Artificial Sequence: Synthetic polypeptide
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3647 - protein, 440 aa, Artificial Sequence; identical to SEQ ID NO: 3551
  Description of Artificial Sequence: Synthetic polypeptide

SEQ ID NO: 3648 - protein, 442 aa, Artificial Sequence
  Description of Artificial Sequence: Synthetic polypeptide
EVQLVQSGAEVKKPGESLRISCKGSGYSFSTYWISWVRQMPGKGLEWMGKIYPGDSYTNYSPSFQGQVTISADKSISTAYLQWSSLKASDTAMYYCARGYGIFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 3649 - protein, 1464 aa, Homo sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 3650 - protein, 1321 aa, Homo sapiens
MSDSVILRSIKKFGEENDGFESDKSYNNDKKSRLQDEKKGDGVRVGFFQLFRFSSSTDIWLMFVGSLCAFLHGIAQPGVLLIFGTMTDVFIDYDVELQELQIPGKACVNNTIVWTNSSLNQNMTNGTRCGLLNIESEMIKFASYYAGIAVAVLITGYIQICFWVIAAARQIQKMRKFYFRRIMRMEIGWFDCNSVGELNTRFSDDINKINDAIADQMALFIQRMTSTICGFLLGFFRGWKLTLVIISVSPLIGIGAATIGLSVSKFTDYELKAYAKAGVVADEVISSMRTVAAFGGEKREVERYEKNLVFAQRWGIRKGIVMGFFTGFVWCLIFLCYALAFWYGSTLVLDEGEYTPGTLVQIFLSVIVGALNLGNASPCLEAFATGRAAATSIFETIDRKPIIDCMSEDGYKLDRIKGEIEFHNVTFHYPSRPEVKILNDLNMVIKPGEMTALVGPSGAGKSTALQLIQRFYDPCEGMVTVDGHDIRSLNIQWLRDQIGIVEQEPVLFSTTIAENIRYGREDATMEDIVQAAKEANAYNFIMDLPQQFDTLVGEGGGQMSGGQKQRVAIARALIRNPKILLLDMATSALDNESEAMVQEVLSKIQHGHTIISVAHRLSTVRAADTIIGFEHGTAVERGTHEELLERKGVYFTLVTLQSQGNQALNEEDIKDATEDDMLARTFSRGSYQDSLRASIRQRSKSQLSYLVHEPPLAVVDHKSTYEEDRKDKDIPVQEEVEPAPVRRILKFSAPEWPYMLVGSVGAAVNGTVTPLYAFLFSQILGTFSIPDKEEQRSQINGVCLLFVAMGCVSLFTQFLQGYAFAKSGELLTKRLRKFGFRAMLGQDIAWFDDLRNSPGALTTRLATDASQVQGAAGSQIGMIVNSFTNVTVAMIIAFSFSWKLSLVILCFFPFLALSGATQTRMLTGFASRDKQALEMVGQITNEALSNIRTVAGIGKERRFIEALETELEKPFKTAIQKANIYGFCFAFAQCIMFIANSASYRYGGYLISNEGLHFSYVFRVISAVVLSATALGRAFSYTPSYAKAKISAARFFQLLDRQPPISVYNTAGEKWDNFQGKIDFVDCKFTYPSRPDSQVLNGLSVSISPGQTLAFVGSSGCGKSTSIQLLERFYDPDQGKVMIDGHDSKKVNVQFLRSNIGIVSQEPVLFACSIMDNIKYGDNTKEIPMERVIAAAKQAQLHDFVMSLPEKYETNVGSQGSQLSRGEKQRIAIARAIVRDPKILLLDEATSALDTESEKTVQVALDKAREGRTCIVIAHRLSTIQNADIIAVMAQGVVIEKGTHEELMAQKGAYYKLVTTGSPIS

SEQ ID NO: 3651 - protein, 654 aa, Homo sapiens
MQAARMAASLGRQLLRLGGGSSRLTALLGQPRPGPARRPYAGGAAQLALDKSDSHPSDALTRKKPAKAESKSFAVGFKGQLTTDQVFPYPSVLNEEQTQFLKELVEPVSRFFEEVNDPAKNDALEMVEETTWQGLKELGAFGLQVPSELGGVGLCNTQYARLVEIVGMHDLGVGITLGAHQSIGFKGILLFGTKAQKEKYLPKLASGETVAAFCLTEPSSGSDAASIRTSAVPSPCGKYYTLNGSKLWISNGGLADIFTVFAKTPVTDPATGAVKEKITAFVVERGFGGITHGPPEKKMGIKASNTAEVFFDGVRVPSENVLGEVGSGFKVAMHILNNGRFGMAAALAGTMRGIIAKAVDHATNRTQFGEKIHNFGLIQEKLARMVMLQYVTESMAYMVSANMDQGATDFQIEAAISKIFGSEAAWKVTDECIQIMGGMGFMKEPGVERVLRDLRIFRIFEGTNDILRLFVALQGCMDKGKELSGLGSALKNPFGNAGLLLGEAGKQLRRRAGLGSGLSLSGLVHPELSRSGELAVRALEQFATVVEAKLIKHKKGIVNEQFLLQRLADGAIDLYAMVVVLSRASRSLSEGHPTAQHEKMLCDTWCIEAAARIREGMAALQSDPWQQELYRNFKSISKALVERGGVVTSNPLGF

SEQ ID NO: 3652 - protein, 1532 aa, Homo sapiens
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 3653 - protein, 2351 aa, Homo sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 3654 - protein, 461 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 3655 - protein, 452 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 3656 - protein, 361 aa, Homo sapiens [sequence omitted]

SEQ ID NO: 3657 - protein, 952 aa, Homo sapiens
MGVRHPPCSHRLLAVCALVSLATAALLGHILLHDFLLVPRELSGSSPVLEETHPAHQQGASRPGPRDAQAHPGRPRAVPTQCDVPPNSRFDCAPDKAITQEQCEARGCCYIPAKQGLQGAQMGQPWCFFPPSYPSYKLENLSSSEMGYTATLTRTTPTFFPKDILTLRLDVMMETENRLHFTIKDPANRRYEVPLETPHVHSRAPSPLYSVEFSEEPFGVIVRRQLDGRVLLNTTVAPLFFADQFLQLSTSLPSQYITGLAEHLSPLMLSTSWTRITLWNRDLAPTPGANLYGSHPFYLALEDGGSAHGVFLLNSNAMDVVLQPSPALSWRSTGGILDVYIFLGPEPKSVVQQYLDVVGYPFMPPYWGLGFHLCRWGYSSTAITRQVVENMTRAHFPLDVQWNDLDYMDSRRDFTFNKDGFRDFPAMVQELHQGGRRYMMIVDPAISSSGPAGSYRPYDEGLRRGVFITNETGQPLIGKVWPGSTAFPDFTNPTALAWWEDMVAEFHDQVPFDGMWIDMNEPSNFIRGSEDGCPNNELENPPYVPGVVGGTLQAATICASSHQFLSTHYNLHNLYGLTEAIASHRALVKARGTRPFVISRSTFAGHGRYAGHWTGDVWSSWEQLASSVPEILQFNLLGVPLVGADVCGFLGNTSEELCVRWTQLGAFYPFMRNHNSLLSLPQEPYSFSEPAQQAMRKALTLRYALLPHLYTLFHQAHVAGETVARPLFLEFPKDSSTWTVDHQLLWGEALLITPVLQAGKAEVTGYFPLGTWYDLQTVPVEALGSLPPPPAAPREPAIHSEGQWVTLPAPLDTINVHLRAGYIIPLQGPGLTTTESRQQPMALAVALTKGGEARGELFWDDGESLEVLERGAYTQVIFLARNNTIVNELVRVTSEGAGLQLQKVTVLGVATAPQQVLSNGVPVSNFTYSPDTKVLDICVSLLMGEQFLVSWC

SEQ ID NO: 3658 - protein, 412 aa, Homo sapiens
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 3659 - protein, 357 aa, Homo sapiens
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRCLNVILWLGFWAVQLNVCLSRIYLAAHFPHQVVAGVLSGIAVAETFSHIHSIYNASLKKYFLITFFLFSFAIGFYLLLKGLGVDLLWTLEKAQRWCEQPEWVHIDTTPFASLLKNLGTLFGLGLALNSSMYRESCKGKLSKWLPFRLSSIVASLVLLHVFDSLKPPSQVELVFYVLSFCKSAVVPLASVSVIPYCLAQVLGQPHKKSL

SEQ ID NO: 3660 - protein, 354 aa, Homo sapiens
MLFNLRILLNNAAFRNGHNFMVRNFRCGQPLQNKVQLKGRDLLTLKNFTGEEIKYMLWLSADLKFRIKQKGEYLPLLQGKSLGMIFEKRSTRTRLSTETGFALLGGHPCFLTTQDIHLGVNESLTDTARVLSSMADAVLARVYKQSDLDTLAKEASIPIINGLSDLYHPIQILADYLTLQEHYSSLKGLTLSWIGDGNNILHSIMMSAAKFGMHLQAATPKGYEPDASVTKLAEQYAKENGTKLLLTNDPLEAAHGGNVLITDTWISMGQEEEKKKRLQAFQGYQVTMKTAKVAASDWTFLHCLPRKPEEVDDEVFYSPRSLVFPEAENRKWTIMAVMVSLLTDYSPQLQKPKF

SEQ ID NO: 3661 - protein, 3684 aa, Homo sapiens
MLWWEEVEDCYEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSDLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFEQRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 3662 - protein, 3121 aa, Homo sapiens
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 3663 - protein, 474 aa, Homo sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 3664 - RNA, 40 nt, Artificial Sequence
  Description of Artificial Sequence: Synthetic polynucleotide
acucacuauuuguuuucgcgcccaguugcaaaaagugucg

SEQ ID NO: 3665 - RNA, 39 nt, Artificial Sequence
  Description of Artificial Sequence: Synthetic polynucleotide
gccagagcaacaaccuuccgagccgcgggauaaaccgag

SEQ ID NO: 3666 - RNA, 40 nt, Artificial Sequence
  Description of Artificial Sequence: Synthetic polynucleotide
ggggaccgcgccccacaugugagugaggccgaaacguaga

SEQ ID NO: 3667 - DNA, 30 bp, Artificial Sequence
  Description of Artificial Sequence: Synthetic oligonucleotide
tataattctaccctattgaggcattgacta

SEQ ID NO: 3668 - protein, 493 aa, Artificial Sequence
  Description of Artificial Sequence: Synthetic polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 3669 - protein, 207 aa, Artificial Sequence
  Description of Artificial Sequence: Synthetic polypeptide
KNQVEQSPQSLIILEGKNCTLQCNYTVSPFSNLRWYKQDTGRGPVSLTIMTFSENTKSNGRYTATLDADTKQSSLHITASQLSDSASYICVVNHSGGSYIPTFGRGTSLIVHPYIQKPDPAVYQLRDSKSSDKSVCLFTDFDSQTNVSQSKDSDVYITDKTVLDMRSMDFKSNSAVAWSNKSDFACANAFNNSIIPEDTFFPSPESS

SEQ ID NO: 3670 - protein, 246 aa, Artificial Sequence
  Description of Artificial Sequence: Synthetic polypeptide
DVKVTQSSRYLVKRTGEKVFLECVQDMDHENMFWYRQDPGLGLRLIYFSYDVKMKEKGDIPEGYSVSREKKERFSLILESASTNQTSMYLCASSFLMTSGDPYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRAD

SEQ ID NO: 3671 - protein, 115 aa, Artificial Sequence
  Description of Artificial Sequence: Synthetic polypeptide
MQEVTQIPAALSVPEGENLVLNCSFTDSAIYNLQWFRQDPGKGLTSLLLIQSSQREQTSGRLNASLDKSSGRSTLYIAASQPGDSATYLCAVRPTSGGSYIPTFGRGTSLIVHPY

SEQ ID NO: 3672 - protein, 112 aa, Artificial Sequence
  Description of Artificial Sequence: Synthetic polypeptide
MGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSYVGNTGELFFGEGSRLTVL

SEQ ID NO: 3673 - protein, 166 aa, Artificial Sequence
  Description of Artificial Sequence: Synthetic polypeptide
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 3674 - protein, 452 aa, Artificial Sequence; identical to SEQ ID NO: 3655
  Description of Artificial Sequence: Synthetic polypeptide

SEQ ID NO: 3675 - protein, 1462 aa, Artificial Sequence
  Description of Artificial Sequence: Synthetic polypeptide
LSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 3676 - protein, 1053 aa, Artificial Sequence
  Description of Artificial Sequence: Synthetic polypeptide
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 3677 - protein, 1353 aa, Artificial Sequence
  Description of Artificial Sequence: Synthetic polypeptide
AAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGTPSLVPHEEAAAPGRTTATPAGASLEWSQARGLLFSPAPQPRRLLPGPQENSVQSSACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 3678 - protein, 431 aa, Artificial Sequence; identical to SEQ ID NO: 3579
  Description of Artificial Sequence: Synthetic polypeptide

SEQ ID NO: 3679 - protein, 160 aa, Artificial Sequence; identical to SEQ ID NO: 3563
  Description of Artificial Sequence: Synthetic polypeptide

SEQ ID NO: 3680 - protein, 133 aa, Artificial Sequence [sequence omitted]

SEQ ID NO: 3681 - protein, 54 aa, Artificial Sequence
  Description of Artificial Sequence: Synthetic polypeptide
MLQMAGQCSQNEYFDSLLHACIPCQLRCSSNTPPLTCQRYCNASVTNSVKGTNA

SEQ ID NO: 3682 - protein, 23 aa, Artificial Sequence
  Description of Artificial Sequence: Synthetic polypeptide
ILWTCLGLSLIISLAVFVLMFLL

SEQ ID NO: 3683 - protein, 107 aa, Artificial Sequence
  Description of Artificial Sequence: Synthetic polypeptide
RKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 3684 - protein, 10 aa, Artificial Sequence
  Description of Artificial Sequence: Synthetic polypeptide
MLQMAGQCSQ

SEQ ID NO: 3685 - protein, 14 aa, Artificial Sequence
  Description of Artificial Sequence: Synthetic polypeptide
CSQNEYFDSLLHAC

SEQ ID NO: 3686 - protein, 13 aa, Artificial Sequence
  Description of Artificial Sequence: Synthetic polypeptide
NEYFDSLLHACIP

SEQ ID NO: 3687 - protein, 11 aa, Artificial Sequence
  Description of Artificial Sequence: Synthetic polypeptide
ACIPCQLRCSS

SEQ ID NO: 3688 - protein, 19 aa, Artificial Sequence
  Description of Artificial Sequence: Synthetic polypeptide
CQLRCSSNTPPLTCQRYCN

SEQ ID NO: 3689 - protein, 10 aa, Artificial Sequence
  Description of Artificial Sequence: Synthetic polypeptide
LTCQRYCNAS

SEQ ID NO: 3690 - protein, 488 aa, Artificial Sequence
  Description of Artificial Sequence: Synthetic polypeptide
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 3691 - protein, 498 aa, Artificial Sequence
  Description of Artificial Sequence: Synthetic polypeptide
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 3692 - protein, 508 aa, Artificial Sequence
  Description of Artificial Sequence: Synthetic polypeptide
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSGGGGSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 3693 - protein, 493 aa, Artificial Sequence
  Description of Artificial Sequence: Synthetic polypeptide
MALPVTALLLPLALLLHAARPEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSGGGGSGGGGSQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 3694 - protein, 498 aa, Artificial Sequence
  Description of Artificial Sequence: Synthetic polypeptide
MALPVTALLLPLALLLHAARPEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSGGGGSGGGGSGGGGSQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 3695 - protein, 503 aa, Artificial Sequence
  Description of Artificial Sequence: Synthetic polypeptide
MALPVTALLLPLALLLHAARPEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSGGGGSGGGGSGGGGSGGGGSQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 3696 - protein, 122 aa, Artificial Sequence
  Description of Artificial Sequence: Synthetic polypeptide
QVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSS

SEQ ID NO: 3697 - protein, 128 aa, Artificial Sequence
  Description of Artificial Sequence: Synthetic polypeptide
QVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSS

SEQ ID NO: 3698 - protein, 118 aa, Artificial Sequence
  Description of Artificial Sequence: Synthetic polypeptide
EVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSS

SEQ ID NO: 3699 - protein, 120 aa, Artificial Sequence
  Description of Artificial Sequence: Synthetic polypeptide
AVQLVDSGGGLVQPGGSLRLSCVASGGIFVINAMGWYRQAPGKQRELVASIRGLGRTNYDDSVKGRFTISRDNANNTVYLQMNSLEPEDTAVYYCTVYVTLLGGVNRDYWGQGTQVTVSS

SEQ ID NO: 3700 - protein, 119 aa, Artificial Sequence
  Description of Artificial Sequence: Synthetic polypeptide
EVQLVESGGGLVQAGGSLRLSCAASGRTFSSIVMGWFRQAPGKEREFVGAIMWNDGITYLQDSVKGRFTIFRDNAKNTVYLQMNSLKLEDTAVYYCAASKGRYSEYEYWGQGTQVTVSS

SEQ ID NO: 3701 - protein, 128 aa, Artificial Sequence
  Description of Artificial Sequence: Synthetic polypeptide
EVQLVESGGGVVQAGGSLTVSCTASGFTFDRAVIVWFRQAPGKGREGVSFIKPSDGTIYYIDSLKGRFTISSDIAKNTVYLQMKSLESEDSAVYYCAASPEDWYTDWIDWSIYRWQHWGQGTQVTVSS

SEQ ID NO: 3702 - protein, 119 aa, Artificial Sequence
  Description of Artificial Sequence: Synthetic polypeptide
EVQLVESGGGMVQAGDSLRLSCVQSTYTVNSDVMGWFRQAPGKEREFVGAIMWNDGITYLQDSVKGRFTIFRDNAKNTVYLQMNSLKLEDTAVYYCAASKGRYSEYEYWGQGTQVTVSS

SEQ ID NO: 3703 - protein, 120 aa, Artificial Sequence
  Description of Artificial Sequence: Synthetic polypeptide
AVQLVESGGGLVQAGDSLRLSCTASGATLTNDHMAWFRQAPGKGREFVAAIDWSGRTTNYADPVEGRFTISRNNAKNTVYLEMNSLKLEDTAVYYCAVLRAWISYDNDYWGQGTQVTVSS

SEQ ID NO: 3704 - protein, 120 aa, Artificial Sequence
  Description of Artificial Sequence: Synthetic polypeptide
QVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSS

SEQ ID NO: 3705 - protein, 119 aa, Artificial Sequence
  Description of Artificial Sequence: Synthetic polypeptide
QVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSS

SEQ ID NO: 3706 - protein, 119 aa, Artificial Sequence
  Description of Artificial Sequence: Synthetic polypeptide
AVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSS

SEQ ID NO: 3707 - protein, 122 aa, Artificial Sequence; identical to SEQ ID NO: 3696
  Description of Artificial Sequence: Synthetic polypeptide

SEQ ID NO: 3708 - protein, 119 aa, Artificial Sequence; identical to SEQ ID NO: 3705
  Description of Artificial Sequence: Synthetic polypeptide

SEQ ID NO: 3709 - protein, 118 aa, Artificial Sequence; identical to SEQ ID NO: 3698
  Description of Artificial Sequence: Synthetic polypeptide

SEQ ID NO: 3710 - protein, 124 aa, Artificial Sequence
  Description of Artificial Sequence: Synthetic polypeptide
EVQLVESGGGLVPPGGSLRLSCTASGSTVSINVMAWYRQVSGKQRELVAAVTRDGRKSCGDSVKGRFTISRDGAKNAVYLQMNSLKPEDTAVYLCGADGWGATTLDYTYGMDYWGKGTQVTVSS

SEQ ID NO: 3711 - protein, 118 aa, Artificial Sequence
  Description of Artificial Sequence: Synthetic polypeptide
AVQLVESGGGLVQAGGSLRLSCAASGRTFTMGWFRQAPGKERGFVASITWDGRSAYYAESVKGRFTISRDNAKNTVVLQMNSLKPEDTALYYCAADRKSVMSIRPDYWGQGTQVTVSS

SEQ ID NO: 3712 - protein, 122 aa, Artificial Sequence
  Description of Artificial Sequence: Synthetic polypeptide
QVQLVESGGGLVQPGGSLRLACEAPGSGNSINAMGWYRQTPGKRRELVATITRGGSTNYGPSVKGRFTITRDNVKNTVHLQMNSLKPDDTAVYYCNAERLDGSGYGYEYDYWGQGTQVTVSS

SEQ ID NO: 3713 - protein, 121 aa, Artificial Sequence
  Description of Artificial Sequence: Synthetic polypeptide
QVKLEESGGGLVQAGGSLRLSCAASGGTLSKNTVAWVRQAPGKERGFVTSITCDGRTTYYANSVNGRFPINRNNAENLVVLQMNSLKPDDTALYYCAAYRKSIMSIQPDYWGQGTQVTVSS

SEQ ID NO: 3714 - protein, 121 aa, Artificial Sequence
  Description of Artificial Sequence: Synthetic polypeptide
DVQLVESGGGLVQAGGSLRLSCAASGRTFSSIVMGWFRQAPGKEREFVGAIMWNDGLTYLQGSVKGRFTISRDNAKNTVVLQMNSLKPEDTALYYCAADRKSVMSIRPDYWGQGTQVTVSS

SEQ ID NO: 3715 - protein, 116 aa, Artificial Sequence
  Description of Artificial Sequence: Synthetic polypeptide
QVQLVESGGGLVQAGGSLRLSCAASGRTFTMGWFRQAPGKEREFVAAISLSPTLAYYAESVKGRFTISRDNAKNTVVLQMNSLKPEDTAVYYCAARRIDAADFDSWGQGTQVTVSS

SEQ ID NO: 3716 - protein, 120 aa, Artificial Sequence; identical to SEQ ID NO: 3704
  Description of Artificial Sequence: Synthetic polypeptide

SEQ ID NO: 3717 - protein, 121 aa, Artificial Sequence
  Description of Artificial Sequence: Synthetic polypeptide
QVQLVESGGGLVQPGGSLTLSCAASGSIDSINTMDWFRQAPGKEREFVAAISLSPTLAYYAESVKGRFTISRDNAKNTVVLQMNSLKPEDTALYYCAADRKSVMSIRPDYWGQGTQVTVSS

SEQ ID NO: 3718 - protein, 120 aa, Artificial Sequence
  Description of Artificial Sequence: Synthetic polypeptide
DVQLVESGGGLVQAGGSLRLSCAASGGTLSKNTVAWVRQAPGKERGFVTSITCDGRTTYYANSVKGRFPISRDNAENTVYLQMNSLKPEDTAGYVCADLGKWPAGSADYWGQGTHVTVSS

SEQ ID NO: 3719 - protein, 121 aa, Artificial Sequence
  Description of Artificial Sequence: Synthetic polypeptide
QVKLEESGGGLVQPGGSLRLSCTASEFTFSDYWMHWVRQAPGKGLEWVASIDTSGQTTYYADSLKGRFTISRDNAKSTLYLQMNSLKSEDTGVYFCAKRYRGGTWYGMANWGKGTQVTVSS

SEQ ID NO: 3720 - protein, 120 aa, Artificial Sequence
  Description of Artificial Sequence: Synthetic polypeptide
QVQLVESGGGLVQAGGSLRLSCAASGRTLSSNTMAWFRQAPGKEREFVASTTWNGRSTYYADSVKGRFTISRDNAKNTMYLQMNSLKPEDTAVYVCADLGKWPAGPADYWGQGTQVTVSS

SEQ ID NO: 3721 - protein, 116 aa, Artificial Sequence
  Description of Artificial Sequence: Synthetic polypeptide
QVQLVESGGGLVQAGGSLRLSCAASGRTFTMGWFRQAPGKQRELVADISGGRTNYADSVKGRFTISRDNAKNTVYLQMNSLKPEDTAVYYCAADRKSVMSIRPDYWGQGTQVTVSS

SEQ ID NO: 3722 - protein, 104 aa, Artificial Sequence
  Description of Artificial Sequence: Synthetic polypeptide
QVQLVESGGGLVQAGASLRLSCAASGRTFTVAAISLSPTLAYYAESVKGRFTISRDNAKNTVVLQMNSLKPEDTALYYCAADRKSVMSIRPDYWGQGTQVTVSS

SEQ ID NO: 3723 - protein, 125 aa, Artificial Sequence
  Description of Artificial Sequence: Synthetic polypeptide
DVQLVESGGGLEQAGGSLRLSCAASGGTLSKNTVAWFRQAPGKERGFVASITWDGRTTYYADSVKGRFTISRDNAKNTVYLQMNSLKPEDTAVYYCASTASCHLFGLGSGAFVSWGRGTQVTVSS

SEQ ID NO: 3724 - protein, 116 aa, Artificial Sequence
  Description of Artificial Sequence: Synthetic polypeptide
AVQLVESGGGLVQAGGSLRLSCAASGRTFTMGWFHQAPGKEREFVAAISLSPTLAYYAESVKGRFTISRDNAKNTVVLQMNSLKPEDTALYYCAASKDRYSEYEYWGQGTQVTVSS

SEQ ID NO: 3725 - protein, 114 aa, Artificial Sequence
  Description of Artificial Sequence: Synthetic polypeptide
QVKLEESGGGLVQAGGSLRLSCAASGRTFTMGWFRQAPGKEREFVAAISLSPTLAYYAESVKGRFTISRDNAKNTVVLQMNSLKPEDTALYYCAKKNGGPVDYWGKGTQVTVSS

SEQ ID NO: 3726 - protein, 119 aa, Artificial Sequence
  Description of Artificial Sequence: Synthetic polypeptide
DVQLVESGGGLVQPGGSLRLSCAASGRTFSSIVMGWFRQAPGKEREFVGAIMWNDGITYLQDSVKGRFTIFRDNAKNTVYLQMNSLKLEDTAVYYCAASKGRYSEYEYWGQGTQVTVSS

SEQ ID NO: 3727 - protein, 118 aa, Artificial Sequence
  Description of Artificial Sequence: Synthetic polypeptide
QVKLEESGGRLVQAGGSLKLSWAASGRTFTMGWFRQAPGKEREFVTAINLSPTLTYYAESVKGRFPISRNNAQNTVVLQMNSLKPEDTALYYCAAERKSVMAIPPDYWGQGTQVTVSS

SEQ ID NO: 3728 - protein, 118 aa, Artificial Sequence; identical to SEQ ID NO: 3727
  Description of Artificial Sequence: Synthetic polypeptide

SEQ ID NO: 3729 - protein, 118 aa, Artificial Sequence
  Description of Artificial Sequence: Synthetic polypeptide
EVQLVESGGGLVQAGGSLRLSCAASGRTFTMGGFRRVPRDEREFVASITLIPTFPYYAYSVKGRFALFRDNPNNTVILLMISLKPEDPDLYYCASYRKYLMSILPDYWGQGTQGTVSS

SEQ ID NO: 3730 - protein, 124 aa, Artificial Sequence
  Description of Artificial Sequence: Synthetic polypeptide
QVKLEESGGGLVQAGGSLRLSCAASGRTFTMGWFRQAPGKEREFVAAISLSPTLAYYAESVKGRFTISRDNAKNTVDLQMNSLKPEDTAVYFCAANRNSQRVIAALSWIGMNYWGEWTQVTVSS

SEQ ID NO: 3731 - protein, 116 aa, Artificial Sequence
  Description of Artificial Sequence: Synthetic polypeptide
QVQLVESGGGLVQAGGSLRLSCAASGRTFTMGWFRQAPGKEREFVAAISLSPTLAYYAESVKGRFTISRDNAKKTLYLRMNSLKPEDTAVYYCAARRIDAADFDSWGQGTQVTVSS

SEQ ID NO: 3732 - protein, 116 aa, Artificial Sequence
  Description of Artificial Sequence: Synthetic polypeptide
QVKLEESGGGLVQAGGSLRLSCAASGRTFTMGWFRRAPGKERESVAVIGWRDINASYADSVKGRFAISRDNAKKTLYLQMNSLKPEDTAVYYCAARRIDATDFDSWGQGTQVTVSS

SEQ ID NO: 3733 - protein, 119 aa, Artificial Sequence
  Description of Artificial Sequence: Synthetic polypeptide
QVKLEESGGGLVQTGGSLRLSCAASEHTFSNHVMGWFRQAPGKERESVAVIGWRDISTSYADSVKGRFTISRDNAKKTLYLQMNSLKPEDTAVYYCAARRIDAADFDSRGQGTQVTVSS

SEQ ID NO: 3734 - protein, 123 aa, Artificial Sequence
  Description of Artificial Sequence: Synthetic polypeptide
AVQLVDSGGGLVQAGGSLRISCAVSGRTSSNYILAWFRQAPGKERDFVAHISRSGGKSGYGDSVKGRFTISRDNAENTVRVYLQMNSLKPGDTAVYYCNRPLWYGSPTLIDYWGQGTQVTVSS

SEQ ID NO: 3735 - protein, 118 aa, Artificial Sequence
  Description of Artificial Sequence: Synthetic polypeptide
QVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSS

SEQ ID NO: 3736 - protein, 118 aa, Artificial Sequence
  Description of Artificial Sequence: Synthetic polypeptide
AVQLVDSGGGLVQAGGSLRLSCAASGRTFTMGWFRQAPGKEREFVAAISLSPTLAYYAEPVKGRFTISRDNAKNTVVLQMNSLKPEDTALYYCAADRKSVMSIRPDYWGQGTQVTVSS

SEQ ID NO: 3737 - protein, 121 aa, Artificial Sequence
  Description of Artificial Sequence: Synthetic polypeptide
DVQLVESGGGSVQTGGSLRLSCTASGRTLNNFVMGWFRQAPGKEREFVAAISLSPTLAYYVESVKGRFTISRDNAKNTVVLQMNSLKPEDTALYYCAADRKSVMSIRPDYWGQGTQVTVSS

SEQ ID NO: 3738 - protein, 210 aa, Artificial Sequence
  Description of Artificial Sequence: Synthetic polypeptide
APGKEREGVICISRSDGSTYYADSVKGRFTISRDNAKKTVYLQMISLKPEDTAAYYCAAGADCSGYLRDYEFRGQGTQVTVSSGGGGSQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSS

SEQ ID NO: 3739 - protein, 376 aa, Artificial Sequence
  Description of Artificial Sequence: Synthetic polypeptide
QVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSGGGGSQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSGGGGSQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSS

SEQ ID NO: 3740 - protein, 242 aa, Artificial Sequence
  Description of Artificial Sequence: Synthetic polypeptide
QVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSS

SEQ ID NO: 3741 - protein, 252 aa, Artificial Sequence
  Description of Artificial Sequence: Synthetic polypeptide
QVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSS

SEQ ID NO: 3742 - protein, 262 aa, Artificial Sequence
  Description of Artificial Sequence: Synthetic polypeptide
QVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSGGGGSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSS

SEQ ID NO: 3743 - protein, 247 aa, Artificial Sequence
  Description of Artificial Sequence: Synthetic polypeptide
EVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSGGGGSGGGGSQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSS

SEQ ID NO: 3744 - protein, 252 aa, Artificial Sequence
  Description of Artificial Sequence: Synthetic polypeptide
EVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSGGGGSGGGGSGGGGSQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSS

SEQ ID NO: 3745 - protein, 257 aa, Artificial Sequence
  Description of Artificial Sequence: Synthetic polypeptide
EVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSGGGGSGGGGSGGGGSGGGGSQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSS

SEQ ID NO: 3746 - protein, 243 aa, Artificial Sequence
  Description of Artificial Sequence: Synthetic polypeptide
QVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSS

SEQ ID NO: 3747 - protein, 253 aa, Artificial Sequence
  Description of Artificial Sequence: Synthetic polypeptide
QVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSS

SEQ ID NO: 3748 - protein, 263 aa, Artificial Sequence
  Description of Artificial Sequence: Synthetic polypeptide
QVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSGGGGSGGGGSAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSS

SEQ ID NO: 3749 - protein, 248 aa, Artificial Sequence
  Description of Artificial Sequence: Synthetic polypeptide
AVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSGGGGSGGGGSQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSS

SEQ ID NO: 3750 - protein, 253 aa, Artificial Sequence
  Description of Artificial Sequence: Synthetic polypeptide
AVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSGGGGSGGGGSGGGGSQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSS

SEQ ID NO: 3751 - protein, 219 aa, Artificial Sequence
  Description of Artificial Sequence: Synthetic polypeptide
APGKEREFVAGIAWSGGSTAYADSVKGRFTISRDNAKNTVYLQMNSLKSEDTAVYYCASRGIEVEEFGAWGQGTQVTVSSGGGGSGGGGSGGGGSGGGGSQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSS

SEQ ID NO: 3752 - protein, 252 aa, Artificial Sequence
  Description of Artificial Sequence: Synthetic polypeptide
EVQLVESGGGMVQAGDSLRLSCVQSTYTVNSDVMGWFRQAPGKEREFVGAIMWNDGITYLQDSVKGRFTIFRDNAKNTVYLQMNSLKLEDTAVYYCAASKGRYSEYEYWGQGTQVTVSSGGGGSQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSS

SEQ ID NO: 3753 - protein, 262 aa, Artificial Sequence
  Description of Artificial Sequence: Synthetic polypeptide
EVQLVESGGGMVQAGDSLRLSCVQSTYTVNSDVMGWFRQAPGKEREFVGAIMWNDGITYLQDSVKGRFTIFRDNAKNTVYLQMNSLKLEDTAVYYCAASKGRYSEYEYWGQGTQVTVSSGGGGSGGGGSGGGGSQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSS

SEQ ID NO: 3754 - protein, 272 aa, Artificial Sequence
  Description of Artificial Sequence: Synthetic polypeptide
EVQLVESGGGMVQAGDSLRLSCVQSTYTVNSDVMGWFRQAPGKEREFVGAIMWNDGITYLQDSVKGRFTIFRDNAKNTVYLQMNSLKLEDTAVYYCAASKGRYSEYEYWGQGTQVTVSSGGGGSGGGGSGGGGSGGGGSGGGGSQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSS

SEQ ID NO: 3755 - protein, 257 aa, Artificial Sequence
  Description of Artificial Sequence: Synthetic polypeptide
EVQLVESGGGMVQAGDSLRLSCVQSTYTVNSDVMGWFRQAPGKEREFVGAIMWNDGITYLQDSVKGRFTIFRDNAKNTVYLQMNSLKLEDTAVYYCAASKGRYSEYEYWGQGTQVTVSSGGGGSGGGGSQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSS

SEQ ID NO: 3756 - protein, 262 aa, Artificial Sequence; identical to SEQ ID NO: 3753
  Description of Artificial Sequence: Synthetic polypeptide

SEQ ID NO: 3757 - protein, 267 aa, Artificial Sequence
  Description of Artificial Sequence: Synthetic polypeptide
EVQLVESGGGMVQAGDSLRLSCVQSTYTVNSDVMGWFRQAPGKEREFVGAIMWNDGITYLQDSVKGRFTIFRDNAKNTVYLQMNSLKLEDTAVYYCAASKGRYSEYEYWGQGTQVTVSSGGGGSGGGGSGGGGSGGGGSQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSS

SEQ ID NO: 3758 - protein, 254 aa, Artificial Sequence
  Description of Artificial Sequence: Synthetic polypeptide
QVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSGGGGSQVKLEESGGGLVQAGGSLRLSCAASGGTLSKNTVAWVRQAPGKERGFVTSITCDGRTTYYANSVNGRFPINRNNAENLVVLQMNSLKPDDTALYYCAAYRKSIMSIQPDYWGQGTQVTVSS

SEQ ID NO: 3759 - protein, 264 aa, Artificial Sequence
  Description of Artificial Sequence: Synthetic polypeptide
QVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSGGGGSGGGGSGGGGSQVKLEESGGGLVQAGGSLRLSCAASGGTLSKNTVAWVRQAPGKERGFVTSITCDGRTTYYANSVNGRFPINRNNAENLVVLQMNSLKPDDTALYYCAAYRKSIMSIQPDYWGQGTQVTVSS

SEQ ID NO: 3760 - protein, 274 aa, Artificial Sequence
  Description of Artificial Sequence: Synthetic polypeptide
QVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSGGGGSGGGGSGGGGSGGGGSGGGGSQVKLEESGGGLVQAGGSLRLSCAASGGTLSKNTVAWVRQAPGKERGFVTSITCDGRTTYYANSVNGRFPINRNNAENLVVLQMNSLKPDDTALYYCAAYRKSIMSIQPDYWGQGTQVTVSS

SEQ ID NO: 3761 - protein, 259 aa, Artificial Sequence
  Description of Artificial Sequence: Synthetic polypeptide
QVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSGGGGSGGGGSQVKLEESGGGLVQAGGSLRLSCAASGGTLSKNTVAWVRQAPGKERGFVTSITCDGRTTYYANSVNGRFPINRNNAENLVVLQMNSLKPDDTALYYCAAYRKSIMSIQPDYWGQGTQVTVSS

SEQ ID NO: 3762 - protein, 264 aa, Artificial Sequence; identical to SEQ ID NO: 3759
  Description of Artificial Sequence: Synthetic polypeptide

SEQ ID NO: 3763 - protein, 269 aa, Artificial Sequence
  Description of Artificial Sequence: Synthetic polypeptide
QVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSGGGGSGGGGSGGGGSGGGGSQVKLEESGGGLVQAGGSLRLSCAASGGTLSKNTVAWVRQAPGKERGFVTSITCDGRTTYYANSVNGRFPINRNNAENLVVLQMNSLKPDDTALYYCAAYRKSIMSIQPDYWGQGTQVTVSS

SEQ ID NO: 3764 - protein, 246 aa, Artificial Sequence
  Description of Artificial Sequence: Synthetic polypeptide
QVKLEESGGGLVQAGGSLRLSCAASGGTLSKNTVAWVRQAPGKERGFVTSITCDGRTTYYANSVNGRFPINRNNAENLVVLQMNSLKPDDTALYYCAAYRKSIMSIQPDYWGQGTQVTVSSGGGGSQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSS

SEQ ID NO: 3765 - protein, 256 aa, Artificial Sequence
  Description of Artificial Sequence: Synthetic polypeptide
QVKLEESGGGLVQAGGSLRLSCAASGGTLSKNTVAWVRQAPGKERGFVTSITCDGRTTYYANSVNGRFPINRNNAENLVVLQMNSLKPDDTALYYCAAYRKSIMSIQPDYWGQGTQVTVSSGGGGSGGGGSGGGGSQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSS

SEQ ID NO: 3766 - protein, 266 aa, Artificial Sequence
  Description of Artificial Sequence: Synthetic polypeptide
QVKLEESGGGLVQAGGSLRLSCAASGGTLSKNTVAWVRQAPGKERGFVTSITCDGRTTYYANSVNGRFPINRNNAENLVVLQMNSLKPDDTALYYCAAYRKSIMSIQPDYWGQGTQVTVSSGGGGSGGGGSGGGGSGGGGSGGGGSQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSS

SEQ ID NO: 3767 - protein, 251 aa, Artificial Sequence
  Description of Artificial Sequence: Synthetic polypeptide
QVKLEESGGGLVQAGGSLRLSCAASGGTLSKNTVAWVRQAPGKERGFVTSITCDGRTTYYANSVNGRFPINRNNAENLVVLQMNSLKPDDTALYYCAAYRKSIMSIQPDYWGQGTQVTVSSGGGGSGGGGSQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSS

SEQ ID NO: 3768 - protein, 256 aa, Artificial Sequence; identical to SEQ ID NO: 3765
  Description of Artificial Sequence: Synthetic polypeptide

SEQ ID NO: 3769 - protein, 261 aa, Artificial Sequence
  Description of Artificial Sequence: Synthetic polypeptide
QVKLEESGGGLVQAGGSLRLSCAASGGTLSKNTVAWVRQAPGKERGFVTSITCDGRTTYYANSVNGRFPINRNNAENLVVLQMNSLKPDDTALYYCAAYRKSIMSIQPDYWGQGTQVTVSSGGGGSGGGGSGGGGSGGGGSQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSS

SEQ ID NO: 3770 - protein, 245 aa, Artificial Sequence
  Description of Artificial Sequence: Synthetic polypeptide
QVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSGGGGSDVQLVESGGGLVQAGGSLRLSCAASGGTLSKNTVAWVRQAPGKERGFVTSITCDGRTTYYANSVKGRFPISRDNAENTVYLQMNSLKPEDTAGYVCADLGKWPAGSADYWGQGTHVTVSS

SEQ ID NO: 3771 - protein, 255 aa, Artificial Sequence
  Description of Artificial Sequence: Synthetic polypeptide
QVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSGGGGSGGGGSGGGGSDVQLVESGGGLVQAGGSLRLSCAASGGTLSKNTVAWVRQAPGKERGFVTSITCDGRTTYYANSVKGRFPISRDNAENTVYLQMNSLKPEDTAGYVCADLGKWPAGSADYWGQGTHVTVSS

SEQ ID NO: 3772 - protein, 265 aa, Artificial Sequence
  Description of Artificial Sequence: Synthetic polypeptide
QVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSGGGGSGGGGSGGGGSGGGGSGGGGSDVQLVESGGGLVQAGGSLRLSCAASGGTLSKNTVAWVRQAPGKERGFVTSITCDGRTTYYANSVKGRFPISRDNAENTVYLQMNSLKPEDTAGYVCADLGKWPAGSADYWGQGTHVTVSS

SEQ ID NO: 3773 - protein, 250 aa, Artificial Sequence
  Description of Artificial Sequence: Synthetic polypeptide
QVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSGGGGSGGGGSDVQLVESGGGLVQAGGSLRLSCAASGGTLSKNTVAWVRQAPGKERGFVTSITCDGRTTYYANSVKGRFPISRDNAENTVYLQMNSLKPEDTAGYVCADLGKWPAGSADYWGQGTHVTVSS

SEQ ID NO: 3774 - protein, 255 aa, Artificial Sequence; identical to SEQ ID NO: 3771
  Description of Artificial Sequence: Synthetic polypeptide

SEQ ID NO: 3775 - protein, 260 aa, Artificial Sequence
  Description of Artificial Sequence: Synthetic polypeptide
QVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSGGGGSGGGGSGGGGSGGGGSDVQLVESGGGLVQAGGSLRLSCAASGGTLSKNTVAWVRQAPGKERGFVTSITCDGRTTYYANSVKGRFPISRDNAENTVYLQMNSLKPEDTAGYVCADLGKWPAGSADYWGQGTHVTVSS

SEQ ID NO: 3776 - protein, 42 aa, Artificial Sequence; identical to SEQ ID NO: 3544
  Description of Artificial Sequence: Synthetic polynucleotide

SEQ ID NO: 3777 - DNA, 549 bp, Unknown
  Caprine kobuvirus IRES
gtggccacgcccgggccaccgatacttcccttcactccttcgggactgttggggaggaacacaacagggctcccctgttttcccattccttcccccttttcccaaccccaaccgccgtatctggtggcggcaagacacacgggtctttccctctaaagcacaattgtgtgtgtgtcccaggtcctcctgcgtacggtgcgggagtgctcccacccaactgttgtaagcctgtccaacgcgtcgtcctggcaagactatgacgtcgcatgttccgctgcggatgccgaccgggtaaccggttccccagtgtgtgtagtgcgatcttccaggtcctcctggttggcgttgtccagaaactgcttcaggtaagtggggtgtgcccaatccctacaaaggttgattctttcaccaccttaggaatgctccggaggtaccccagcaacagctgggatctgaccggaggctaattgtctacgggtggtgtttcctttttcttttcacacaactctactgcgtacaactcactgactatccacttgctctgtcacg

SEQ ID NO: 3778 - RNA, 15 nt, Artificial Sequence
  Description of artificial sequence: poly(A) tail
aaaaaaaaaaaaaaa

SEQ ID NO: 3779 - DNA, 10 bp, Artificial Sequence
  Description of artificial sequence: deoxythymidine oligonucleotide
tttttttttt
